(12) United States Patent
Cowens et al.

(10) Patent No.: US 7,695,913 B2
(45) Date of Patent: Apr. 13, 2010

(54) GENE EXPRESSION MARKERS FOR COLORECTAL CANCER PROGNOSIS

(75) Inventors: Wayne Cowens, Tiburon, CA (US); Joffre B. Baker, Montara, CA (US); Kim Clark, Sunnyvale, CA (US); James Hackett, San Jose, CA (US); Drew Watson, Los Altos, CA (US); Soonmyung Paik, Pittsburgh, PA (US)

(73) Assignees: Genomic Health, Inc., Redwood City, CA (US); NSABP Foundation, Inc., Pittsburgh, PA (US)

( * ) Notice: Subject to any disclaimer, the term of this patent is extended or adjusted under 35 U.S.C. 154(b) by 236 days.

(21) Appl. No.: 11/653,102

(22) Filed: Jan. 11, 2007

(65) Prior Publication Data

US 2009/0291434 A1 Nov. 26, 2009

Related U.S. Application Data

(60) Provisional application No. 60/758,392, filed on Jan. 11, 2006, provisional application No. 60/800,277, filed on May 12, 2006, provisional application No. 60/810,077, filed on May 31, 2006.

(51) Int. Cl.
*C12Q 1/68* (2006.01)
(52) U.S. Cl. ......................................................... 435/6
(58) Field of Classification Search ...................... None
See application file for complete search history.

(56) References Cited

U.S. PATENT DOCUMENTS

2003/0148314 A1 8/2003 Berger et al. .................... 435/6

FOREIGN PATENT DOCUMENTS

WO WO 03/050243 6/2003

OTHER PUBLICATIONS

Arango et al., "Gene-Expressed Profiling Predicts Recurrence in Dukes' C Colorectal Cancer" Gastroenterology, vol. 129, pp. 874-884 (2005) XP00531470 ISSN: 0016-5085.
Barrier et al., "Gene Expression Profiling of Nonneoplastic Mucosa may Predict Clinical Outcome of Colon Cancer Patients" Diseases of the Colon & Rectum, Springer-Verlag, NE, vol. 48, No. 12, pp. 2238-2248 (2005) XP019368711 ISSN: 1530-0358.
Lee, et al., "Diffferential Effects of Retinoic Acid on Growth and Apoptosis in Human Colon Cancer Cell Lines Associated with the Induction of Retinoic Acid Receptor Beta" Biochemical Pharmacology, vol. 59, No. 5, pp. 485-496 (2000) XP002445903 ISSN: 0006-2952.
Rosati et al., "Thymidylate Synthase Expression, p53, bc1-2, Ki-67 and p27 in Colorectal Cancer: Relationships with Tumor Recurrence and Survival" Tumor Biology, Karger, Basel, CH, vol. 25, No. 5-6, pp. 258-263 (2004) XP009087940 ISSN: 1010-4283.
Sarela et al., "Expression of the Antiapoptosis Gene, Survivin, Predicts Death from Recurrent Colorectal Carcinoma" Gut British Medical Association, London, GB, vol. 46, No. 5, pp. 645-650 (2000) XP001098316 ISSN: 0017-5749.
Sun et al., "Retinoic Acid Receptor Beta and Colon Cancer" Cancer Biology & Therapy, vol. 3, No. 1, pp. 87-88 (2004) XP002445903 ISSN: 0006-2952.
Youssef et al., "Methylation and Regulation of Expression of Different Retinoic Acid Receptor Beta Isoforms in Human Colon Cancer" Cancer Biology & Therapy, vol. 3, No. 1, pp. 82-86 (2004) XP002445905 ISSN: 1538-4047.
Wildi, S. et al., "Overexpression of Activin A in Stage IV Colorectal Cancer" Gut, British Medical Association, London, GB vol. 49, pp. 40-417 (2001) XP008075384. ISSN: 0017-5749.
Bertucci et al., Gene expression profiling of primary breast carcinomas using arrays of candidate genes. Human Molecular Genetics 2000; 9(20): 2981-91.
Callagy et al., Bcl-2 is a prognostic marker in breast cancer independently of the Nottingham Prognostic Index. Clin. Cancer Res. 2006; 12(8):2468-75.
Kononen et al., Tissue microarrays for high-throughput molecular profiling of tumor specimens. Nature Medicine 1998; 4(7):844-7.
Modlich et al., Predictors of primary breast cancers responsiveness to preoperative Epirubicin/Cyclophosphamide-based chemotherapy: transition of microarray data into clinically useful predictive signatures. J. Translational Medicine 2005; 3:32.
Nakopoulou et al., Stromelysin-3 protein expression in invasive breast cancer: Relation to proliferation, cell survival and patients' outcome. Modern Pathology 2002; 15(11):1154-61.
Nessling et al., Candidate genes in breast cancer revealed by microarray-based comparative genomic hybridization of archived tissue. Cancer Res. 2005; 65(2):439-47.
Urruticoechea et al., Proliferation marker Ki-67 in early breast cancer. J. Clin. Oncology 23:7212-20 (2005).

*Primary Examiner*—James Martinell

(57) ABSTRACT

A method of predicting clinical outcome in a subject diagnosed with colorectal cancer comprising determining evidence of the expression of one or more predictive RNA transcripts or their expression products in a biological sample of cancer cells obtained from the subject.

18 Claims, 1 Drawing Sheet

GENE EXPRESSION MARKERS FOR COLORECTAL CANCER PROGNOSIS

CROSS-REFERENCE TO RELATED APPLICATIONS

This is a non-provisional application filed under 37 C.F.R. 1.53(b) claiming priority under 35 U.S.C. §119(e) to provisional Application Ser. No. 60/758,392 filed Jan. 11, 2006 and to provisional Application Ser. No. 60/800,277 filed May 12, 2006 and to provisional Application Ser. No. 60/810,077 filed May 31, 2006 all of which are incorporated herein by reference in their entirety.

BACKGROUND OF THE INVENTION

1. Field of the Invention

The present invention provides genes and gene sets, the expression levels of which are useful for predicting outcome of colorectal cancer.

2. Description of Related Art

Colorectal cancer is the number two cause of cancer-related death in the United States and the European Union, accounting for 10% of all cancer-related deaths. Although colon cancer and rectal cancer may represent identical or similar disease at the molecular level, surgery for rectal cancer is complicated by anatomical issues. Possibly for this reason, the rate of local recurrence for rectal cancer is significantly higher than for colon cancer, and so the treatment approach is significantly different. Approximately 100,000 colon cancers are newly diagnosed each year in the United States, with about 65% of these being diagnosed as stage II/III colorectal cancer as discussed below.

Refining a diagnosis of colorectal cancer involves evaluating the progression status of the cancer using standard classification criteria. Two classification systems have been widely used in colorectal cancer, the modified Duke's or Astler-Coller staging system (Stages A-D) (Astler V B, Coller F A., *Ann Surg* 1954; 139:846-52), and more recently TNM staging (Stages I-IV) as developed by the American Joint Committee on Cancer (*AJCC Cancer Staging Manual,* 6th Edition, Springer-Verlag, New York, 2002). Both systems apply measures of the spread of the primary tumor through layers of colon or rectal wall to the adjacent organs, lymph nodes and distant sites to evaluate tumor progression. Estimates of recurrence risk and treatment decisions in colon cancer are currently based primarily on tumor stage.

There are approximately 33,000 newly diagnosed Stage II colorectal cancers each year in the United States. Nearly all of these patients are treated by surgical resection of the tumor and, in addition, about 40% are currently treated with chemotherapy based on 5-fluorouracil (5-FU). The decision whether to administer adjuvant chemotherapy is not straightforward. The five-year survival rate for Stage II colon cancer patients treated with surgery alone is approximately 80%. Standard adjuvant treatment with 5-FU+leucovorin (folinic acid) demonstrates an absolute benefit of only 2-4% in this population and shows significant toxicity, including a rate of toxic death from chemotherapy as high as 1%. Thus, a large number of patients receive toxic therapy from which only a few benefit.

A test capable of prognosis after surgery in Stage II colorectal cancer patients would be of great benefit for guiding treatment decisions for these patients.

The benefit of chemotherapy in Stage III colon cancer is more evident than it is in Stage II. A large proportion of the 31,000 patients annually diagnosed with Stage III colon cancer receive 5-FU-based adjuvant chemotherapy, and the absolute benefit of 5-FU+leucovorin in this setting is around 18-24%, depending on the particular regimen employed. Current standard-of-care chemotherapy treatment for Stage III colon cancer patients (5-FU+leucovorin or 5-FU+leucovorin+oxaliplatin) is moderately effective, achieving an improvement in 5-yr survival rate from about 50% (surgery alone) to about 65% (5-FU+leucovorin) or 70% (5-FU+leucovorin+oxaliplatin). Treatment with 5-FU+leucovorin alone or in combination with oxaliplatin is accompanied by a range of adverse side-effects, including toxic death in approximately 1% of patients treated. Furthermore, the three-year survival rate for Stage III colon cancer patients treated with surgery alone is about 47% and it has not been established whether a subset of Stage III patients exists for which recurrence risk resembles that observed for Stage II patients.

A test that would quantify recurrence risk based on molecular markers rather than tumor stage alone would be useful for identifying a subset of Stage III patients that may not require adjuvant therapy to achieve acceptable outcomes.

Staging of rectal tumors is carried out based on similar criteria as for colon tumor staging, although there are some differences resulting for example from differences in the arrangement of the draining lymph nodes. As a result, Stage II/III rectal tumors bear a reasonable correlation to Stage II/III colon tumors as to their state of progression. As noted above, the rate of local recurrence and other aspects of prognosis differ between rectal cancer and colon cancer, and these differences may arise from difficulties in accomplishing total resection of rectal tumors. Nevertheless, there is no compelling evidence that there is a difference between colon cancer and rectal cancer as to the molecular characteristics of the respective tumors. Prognostic tests for rectal cancer would have utility similar in nature as described for colon cancer prognostic tests and the same prognostic markers might well apply to both cancer types.

In addition, there is a clear need for safer and more efficacious drugs for the treatment of colon cancer. Current chemotherapy for colon cancer is based on the relatively crude approach of administering drugs that generally interfere with the proliferation of dividing cells. Recent clinical studies have demonstrated the feasibility of developing improved drugs based on detailed molecular understanding of particular cancer types and subtypes. For example, the HER2 (ERBB2) gene is amplified and the HER2 protein is overexpressed in a subset of breast cancers; HERCEPTIN® (Genentech, Inc.) a drug developed to target HER2, is indicated only for those patients who have an higher than normal copy number of HER2 as demonstrated by fluorescent in situ hybridization (FISH) or a high level of HER2 expression as demonstrated by immunohistochemistry. Genes, whose expression is associated with clinical outcome in human cancer patients, are a valuable resource for selection of targets for drug compound screening and further drug development activities.

Molecularly targeted drugs, such as HERCEPTIN® (Genentech, Inc.) can be developed and commercialized in conjunction with a diagnostic test that can identify patients who are likely to benefit from the drug; one aspect of such a test is the identification of those patients likely to have a positive outcome without any treatment other than surgery. For example, 80% of Stage II colon cancer patients survive five years or more when treated with surgery alone. Gene markers that identify patients more likely to be among the 20% whose cancer will recur without additional treatment are useful in drug development, for example in screening patients for inclusion in a clinical trial.

SUMMARY OF THE INVENTION

In one aspect, the present invention concerns a method for predicting the clinical outcome in a subject diagnosed with colorectal cancer following surgical resection of said cancer, comprising determining the expression level of one or more predictive RNA transcripts listed in Tables 1A-B, 2A-B, 3A-B, 4A-B, 5A-B, 6 and/or 7, or their expression products, in a biological sample comprising cancer cells obtained from said subject wherein: (a) evidence of increased expression of one or more of the genes listed in Table 1A, 2A, 3A, 4A, and/or 5A, or the corresponding expression product, indicates a decreased likelihood of a positive clinical outcome; and (b) evidence of increased expression of one or more of the genes listed in Table 1B, 2B, 3B, 4B and/or 5B, or the corresponding expression product, indicates an increased likelihood of a positive clinical outcome. It is contemplated that if the likelihood of positive clinical outcome is predicted to be decreased said patient is subjected to further therapy following said surgical removal. It is further contemplated that the therapy is chemotherapy and/or radiation therapy.

The clinical outcome of the method of the invention may be expressed, for example, in terms of Recurrence-Free Interval (RFI), Overall Survival (OS), Disease-Free Survival (DFS), or Distant Recurrence-Free Interval (DRFI).

In one embodiment, the cancer is Dukes B (stage II) or Dukes C (stage III) colorectal cancer.

In another aspect, the invention concerns a method of predicting the duration of Recurrence-Free Interval (RFI) in a subject diagnosed with Dukes B (stage II) or Dukes C (stage III) colorectal cancer following surgical resection of said cancer, comprising determining the expression level of one or more predictive RNA transcripts listed in Tables 1A, 5A, 1B, and/or 5B, or their expression products, in a biological sample comprising cancer cells obtained from said subject, wherein: (a) evidence of increased expression of one or more of the genes listed in Table 1A or 5A, or the corresponding expression product, indicates that said RFI is predicted to be shorter; and (b) evidence of increased expression of one or more of the genes listed in Table 1B, or 5B, or the corresponding expression product, indicates that said RFI is predicted to be longer.

In another aspect, the invention concerns a method of predicting Overall Survival (OS) in a subject diagnosed with Dukes B (stage II) or Dukes C (stage III) colon cancer following surgical resection of said cancer, comprising determining the expression level of one or more predictive RNA transcripts listed in Tables 2A and/or 2B, or their expression products, in a biological sample comprising cancer cells obtained from said subject, wherein: (a) evidence of increased expression of one or more of the genes listed in Table 2A, or the corresponding expression product, indicates that said OS is predicted to be shorter; and (b) evidence of increased expression of one or more of the genes listed in Table 2B, or the corresponding expression product, indicates that said OS is predicted to be longer.

In another aspect, the invention concerns a method of predicting Disease-Free Survival (DFS) in a subject diagnosed with Dukes B (stage II) or Dukes C (stage III) colon cancer following surgical resection of said cancer, comprising determining the expression level of one or more predictive RNA transcripts listed in Tables 3A, and/or 3B, or their expression products, in a biological sample comprising cancer cells obtained from said subject, wherein: (a) evidence of increased expression of one or more of the genes listed in Table 3A, or the corresponding expression product, indicates that said DFS is predicted to be shorter; and (b) evidence of increased expression of one or more of the genes listed in Table 3B, or the corresponding expression product, indicates that said DFS is predicted to be longer.

In another aspect, the invention concerns a method of predicting the duration of Distant Recurrence-Free Interval (DRFI) in a subject diagnosed with Dukes B (stage II) or Dukes C (stage III) colon cancer following surgical resection of said cancer, comprising determining the expression level of one or more predictive RNA transcripts listed in Tables 4A and/or 4B, or their expression products, in a biological sample comprising cancer cells obtained from said subject, wherein: (a) evidence of increased expression of one or more of the genes listed in Table 4A, or the corresponding expression product, indicates that said DRFI is predicted to be shorter; and (b) evidence of increased expression of one or more of the genes listed in Table 4B, or the corresponding expression product, indicates that said DRFI is predicted to be longer.

In another aspect, the invention concerns a method of predicting clinical outcome for a subject diagnosed with colorectal cancer following surgical resection of said cancer, comprising determining evidence of the expression level of one or more predictive RNA transcripts listed in Tables 1.2A-B, 2.2A-B, 3.2A-B, 4.2A-B, 5.2A-B, 6.2 and/or 7.2, or their expression products, in a biological sample comprising cancer cells obtained from said subject, wherein (a) evidence of increased expression of one or more of the genes listed in Table 1.2A, 2.2A, 3.2A, 4.2A and/or 5.2A, or the corresponding expression product, indicates a decreased likelihood of a positive clinical outcome; and (b) evidence of increased expression of one or more of the genes listed in Table 1.2B, 2.2B, 3.2B, 4.2B and/or 5.2B, or the corresponding expression product, indicates an increased likelihood of a positive clinical outcome.

In another aspect, the invention concerns a method of predicting the duration of Recurrence-Free Interval (RFI) in a subject diagnosed with Dukes B (stage II) or Dukes C (stage III) colorectal cancer following surgical resection of said cancer, comprising determining the expression level of one or more predictive RNA transcripts listed in Tables 1.2A, 1.2B, 5.2A and/or 5.2B, or their expression products, in a biological sample comprising cancer cells obtained from said subject, wherein (a) evidence of increased expression of one or more of the genes listed in Table 1.2A or 5.2A, or the corresponding expression product, indicates that said RFI is predicted to be shorter; and (b) evidence of increased expression of one or more of the genes listed in Table 1.2B or 5.2B, or the corresponding expression product, indicates that said RFI is predicted to be longer.

In another aspect, the invention concerns a method of predicting Overall Survival (OS) in a subject diagnosed with Dukes B (stage II) or Dukes C (stage III) colon cancer following surgical resection of said cancer, comprising determining the expression level of one or more predictive RNA transcripts listed in Tables 2.2A and/or 2.2B, or their expression products, in a biological sample comprising cancer cells obtained from said subject, wherein (a) evidence of increased expression of one or more of the genes listed in Table 2.2A, or the corresponding expression product, indicates that said OS is predicted to be shorter; and (b) evidence of increased expression of one or more of the genes listed in Table 2.2B, or the corresponding expression product, indicates that said OS is predicted to be longer.

In another aspect, the invention concerns a method of predicting Disease-Free Survival (DFS) in a subject diagnosed with Dukes B (stage II) or Dukes C (stage III) colon cancer following surgical resection of said cancer, comprising determining the expression level of one or more predictive RNA transcripts listed in Tables 3.2A and/or 3.2B, or their expression products, in a biological sample comprising cancer cells obtained from said subject, wherein (a) evidence of increased expression of one or more of the genes listed in Table 3.2A, or the corresponding expression product, indicates that said DFS is predicted to be shorter; and (b) evidence of increased expression of one or more of the genes listed in Table 3.2B, or the corresponding expression product, indicates that said DFS is predicted to be longer.

In another aspect, the invention concerns a method of predicting the duration of Distant Recurrence-Free Interval (DRFI) in a subject diagnosed with Dukes B (stage II) or Dukes C (stage III) colon cancer following surgical resection of said cancer, comprising determining the expression level of one or more predictive RNA transcripts listed in Tables 4.2A and/or 4.2B, or their expression products, in a biological sample comprising cancer cells obtained from said subject, wherein (a) evidence of increased expression of one or more of the genes listed in Table 4.2A, or the corresponding expression product, indicates that said DRFI is predicted to be shorter; and (b) evidence of increased expression of one or more of the genes listed in Table 4.2B, or the corresponding expression product, indicates that said DRFI is predicted to be longer.

In another aspect, the invention concerns a method of predicting clinical outcome for a subject diagnosed with colorectal cancer following surgical resection of said cancer, comprising determining evidence of the expression level of one or more predictive RNA transcripts listed in Tables 1A-B, 1.2A-B, 2A-B, 2.2A-B, 3A-B, 3.2A-B, 4A-B, 4.2A-B, 5A-B, 5.2A-B, 6, 6.2, 7 and/or 7.2, or their expression products, in a biological sample comprising cancer cells obtained from said subject, wherein (a) evidence of increased expression of one or more of the genes listed in Table 1A, 1.2A, 2A, 2.2A, 3A, 3.2A, 4A, 4.2A, 5A and/or 5.2A, or the corresponding expression product, indicates a decreased likelihood of a positive clinical outcome; and (b) evidence of increased expression of one or more of the genes listed in Table 1B, 1.2B, 2B, 2.2B, 3B, 3.2B, 4B, 4.2B, 5B and/or 5.2B, or the corresponding expression product, indicates an increased likelihood of a positive clinical outcome.

In another aspect, the invention concerns a method of predicting the duration of Recurrence-Free Interval (RFI) in a subject diagnosed with Dukes B (stage II) or Dukes C (stage III) colorectal cancer following surgical resection of said cancer, comprising determining the expression level of one or more predictive RNA transcripts listed in Tables 1A, 1.2A, 1B, 1.2B, 5A, 5.2A, 5B and/or 5.2B, or their expression products, in a biological sample comprising cancer cells obtained from said subject, wherein (a) evidence of increased expression of one or more of the genes listed in Table 1A, 1.2A, 5A and/or 5.2A, or the corresponding expression product, indicates that said RFI is predicted to be shorter; and (b) evidence of increased expression of one or more of the genes listed in Table 1B, 1.2B, 5B and/or 5.2B, or the corresponding expression product, indicates that said RFI is predicted to be longer.

In another aspect, the invention concerns a method of predicting Overall Survival (OS) in a subject diagnosed with Dukes B (stage II) or Dukes C (stage III) colon cancer following surgical resection of said cancer, comprising determining the expression level of one or more predictive RNA transcripts listed in Tables 2A, 2.2A, 2B and/or 2.2B, or their expression products, in a biological sample comprising cancer cells obtained from said subject, wherein (a) evidence of increased expression of one or more of the genes listed in Table 2A and/or 2.2A, or the corresponding expression product, indicates that said OS is predicted to be shorter; and (b) evidence of increased expression of one or more of the genes listed in Table 2B and/or 2.2B, or the corresponding expression product, indicates that said OS is predicted to be longer.

In another aspect, the invention concerns a method of predicting Disease-Free Survival (DFS) in a subject diagnosed with Dukes B (stage II) or Dukes C (stage III) colon cancer following surgical resection of said cancer, comprising determining the expression level of one or more predictive RNA transcripts listed in Tables 3A, 3.2A, 3B and/or 3.2B, or their expression products, in a biological sample comprising cancer cells obtained from said subject, wherein (a) evidence of increased expression of one or more of the genes listed in Table 3A and/or 3.2A, or the corresponding expression product, indicates that said DFS is predicted to be shorter; and (b) evidence of increased expression of one or more of the genes listed in Table 3B and/or 3.2B, or the corresponding expression product, indicates that said DFS is predicted to be longer.

In another aspect, the invention concerns a method of predicting the duration of Distant Recurrence-Free Interval (DRFI) in a subject diagnosed with Dukes B (stage II) or Dukes C (stage III) colon cancer following surgical resection of said cancer, comprising determining the expression level of one or more predictive RNA transcripts listed in Tables 4A, 4.2A, 4B and/or 4.2B, or their expression products, in a biological sample comprising cancer cells obtained from said subject, wherein (a) evidence of increased expression of one or more of the genes listed in Table 4A and/or 4.2A, or the corresponding expression product, indicates that said DRFI is predicted to be shorter; and (b) evidence of increased expression of one or more of the genes listed in Table 4B and/or 4.2B, or the corresponding expression product, indicates that said DRFI is predicted to be longer.

In another aspect, the invention concerns a method of predicting clinical outcome in a subject diagnosed with Dukes B (stage II) colorectal cancer following surgical resection of said cancer, comprising determining the expression level of one or more predictive RNA transcripts selected from the group consisting of ALCAM, CD24, CDH11, CENPE, CLTC, CYR61, EMR3, ICAM2, LOX, MADH2, MGAT5, MT3, NUFIP1, PRDX6, SIR2, SOS1, STAT5B, TFF3, TMSB4X, TP53BP1, WIF, CAPG, CD28, CDC20, CKS1B, DKK1, HSD17B2, and MMP7, or their expression products, in a biological sample comprising cancer cells obtained from said subject, wherein: (a) evidence of increased expression of one or more of the genes selected from the group consisting of ALCAM, CD24, CDH11, CENPE, CLTC, CYR61, EMR3, ICAM2, LOX, MADH2, MGAT5, MT3, NUFIP1, PRDX6, SIR2, SOS1, STAT5B, TFF3, TMSB4X, TP53BP1, and WIF, or the corresponding expression product, indicates a decreased likelihood of positive clinical outcome; and (b) evidence of increased expression of one or more of the genes selected from the group consisting of CAPG, CD28, CDC20, CKS1B, DKK1, HSD17B2, and MMP7, or the corresponding expression product, indicates an increased likelihood of positive clinical outcome.

In another aspect, the invention concerns a method of predicting clinical outcome in a subject diagnosed with Dukes C (stage III) colorectal cancer following surgical resection of said cancer, comprising determining the expression level of one or more predictive RNA transcripts selected from the group consisting of CAPG, CD28, CKS1B, CYR61, DKK1, HSD17B2, LOX, MMP7, SIR2, ALCAM, CD24, CDC20, CDH11, CENPE, CLTC, EMR3, ICAM2, MADH2, MGAT5, MT3, NUFIP1, PRDX6, SOS1, STAT5B, TFF3, TMSB4X, TP53BP1, and WIF, or their expression products, in a biological sample comprising cancer cells obtained from said subject, wherein: (a) evidence of increased expression of one or more of the genes selected from the group consisting of CAPG, CD28, CKS1B, CYR61, DKK1, HSD17B2, LOX, MMP7, and SIR2, or the corresponding expression product, indicates a decreased likelihood of positive clinical outcome; and (b) evidence of increased expression of one or more of the genes selected from the group consisting of ALCAM, CD24, CDC20, CDH11, CENPE, CLTC, EMR3, ICAM2, MADH2, MGAT5, MT3, NUFIP1, PRDX6, SOS1, STAT5B, TFF3, TMSB4X, TP53BP1, and WIF, or the corresponding expression product, indicates an increased likelihood of positive clinical outcome.

For all aspects of the method of the invention, determining the expression level of one or more genes may be obtained, for example, by a method of gene expression profiling. The method of gene expression profiling may be, for example, a PCR-based method.

For all aspects of the invention, the expression levels of the genes may be normalized relative to the expression levels of one or more reference genes, or their expression products.

For all aspects of the invention, the subject preferably is a human patient.

For all aspects of the invention, the method may further comprise determining evidence of the expression levels of at least two of said genes, or their expression products. It is further contemplated that the method of the invention may further comprise determining evidence of the expression levels of at least three of said genes, or their expression products. It is also contemplated that the method of the invention may further comprise determining evidence of the expression levels of at least four of said genes, or their expression products. It is also contemplated that the method of the invention may further comprise determining evidence of the expression levels of at least five of said genes, or their expression products.

For all aspects of the invention, the method may further comprise the step of creating a report summarizing said prediction.

For all aspects of the invention, it is contemplated that for every increment of an increase in the level of one or more predictive RNA transcripts or their expression products, the patient is identified to show an incremental increase in clinical outcome.

For all aspects of the invention, the determination of expression levels may occur more than one time. For all aspects of the invention, the determination of expression levels may occur before the patient is subjected to any therapy following surgical resection.

In a different aspect the invention is directed to a report comprising the predicted clinical outcome in a subject diagnosed with colorectal cancer following surgical resection of said cancer, comprising a prediction of clinical outcome based on information comprising the expression level of one or more predictive RNA transcripts listed in Tables 1A-B, 2A-B, 3A-B, 4A-B, 5A-B, 6 and/or 7, or their expression products, in a biological sample comprising cancer cells obtained from said subject wherein: (a) evidence of increased expression of one or more of the genes listed in Table 1A, 2A, 3A, 4A, and/or 5A, or the corresponding expression product, indicates a decreased likelihood of a positive clinical outcome; and (b) evidence of increased expression of one or more of the genes listed in Table 1B, 2B, 3B, 4B and/or 5B, or the corresponding expression product, indicates an increased likelihood of a positive clinical outcome. The clinical outcome of the report of the invention may be expressed, for example, in terms of Recurrence-Free Interval (RFI), Overall Survival (OS), Disease-Free Survival (DFS), or Distant Recurrence-Free Interval (DRFI). In one embodiment that cancer is Dukes B (stage II) or Dukes C (stage III) colorectal cancer. The prediction of clinical outcome may comprise an estimate of the likelihood of a particular clinical outcome for a subject or may comprise the classification of a subject into a risk group based on said estimate.

In another aspect the invention is directed to a report predicting clinical outcome for a subject diagnosed with colorectal cancer following surgical resection of said cancer, comprising a prediction of clinical outcome based on information comprising the expression level of one or more predictive RNA transcripts listed in Tables 1.2A-B, 2.2A-B, 3.2A-B, 4.2A-B, 5.2A-B, 6.2 and/or 7.2, or their expression products, in a biological sample comprising cancer cells obtained from said subject, wherein (a) evidence of increased expression of one or more of the genes listed in Table 1.2A, 2.2A, 3.2A, 4.2A and/or 5.2A, or the corresponding expression product, indicates a decreased likelihood of a positive clinical outcome; and (b) evidence of increased expression of one or more of the genes listed in Table 1.2B, 2.2B, 3.2B, 4.2B and/or 5.2B, or the corresponding expression product, indicates an increased likelihood of a positive clinical outcome. The clinical outcome of the report of the invention may be expressed, for example, in terms of Recurrence-Free Interval (RFI), Overall Survival (OS), Disease-Free Survival (DFS), or Distant Recurrence-Free Interval (DRFI). In one embodiment that cancer is Dukes B (stage II) or Dukes C (stage III) colorectal cancer. The prediction of clinical outcome may comprise an estimate of the likelihood of a particular clinical outcome for a subject or may comprise the classification of a subject into a risk group based on said estimate.

In another aspect, the invention concerns a report predicting clinical outcome for a subject diagnosed with colorectal cancer following surgical resection of said cancer, comprising a prediction of clinical outcome based on information comprising the expression level of one or more predictive RNA transcripts listed in Tables A-B, 1.2A-B, 2A-B, 2.2A-B, 3A-B, 3.2A-B, 4A-B, 4.2A-B, 5A-B, 5.2A-B, 6, 6.2, 7 and/or 7.2, or their expression products, in a biological sample comprising cancer cells obtained from said subject, wherein (a) evidence of increased expression of one or more of the genes listed in Table 1A, 1.2A, 2A, 2.2A, 3A, 3.2A, 4A, 4.2A, 5A and/or 5.2A, or the corresponding expression product, indicates a decreased likelihood of a positive clinical outcome; and (b) evidence of increased expression of one or more of the genes listed in Table 1B, 1.2B, 2B, 2.2B, 3B, 3.2B, 4B, 4.2B, 5B and/or 5.2B, or the corresponding expression product, indicates an increased likelihood of a positive clinical outcome. The prediction of clinical outcome may comprise an estimate of the likelihood of a particular clinical outcome for a subject or may comprise the classification of a subject into a risk group based on said estimate.

In another aspect the invention is directed to a report predicting clinical outcome in a subject diagnosed with Dukes B (stage II) colorectal cancer following surgical resection of said cancer, comprising a prediction of clinical outcome based on information comprising the expression level of one or more predictive RNA transcripts selected from the group consisting of ALCAM, CD24, CDH11, CENPE, CLTC, CYR61, EMR3, ICAM2, LOX, MADH2, MGAT5, MT3, NUFIP1, PRDX6, SIR2, SOS1, STAT5B, TFF3, TMSB4X, TP53BP1, WIF, CAPG, CD28, CDC20, CKS1B, DKK1, HSD17B2, and MMP7, or their expression products, in a biological sample comprising cancer cells obtained from said subject, wherein: (a) evidence of increased expression of one or more of the genes selected from the group consisting of ALCAM, CD24, CDH11, CENPE, CLTC, CYR61, EMR3, ICAM2, LOX, MADH2, MGAT5, MT3, NUFIP1, PRDX6, SIR2, SOS1, STAT5B, TFF3, TMSB4X, TP53BP1, and WIF, or the corresponding expression product, indicates a decreased likelihood of positive clinical outcome; and (b) evidence of increased expression of one or more of the genes selected from the group consisting of CAPG, CD28, CDC20, CKS1B, DKK1, HSD17B2, and MMP7, or the corresponding expression product, indicates an increased likelihood of positive clinical outcome. The prediction of clinical outcome may comprise an estimate of the likelihood of a particular clinical outcome for a subject or may comprise the classification of a subject into a risk group based on said estimate.

In another aspect the invention is directed to a report predicting clinical outcome in a subject diagnosed with Dukes C (stage III) colorectal cancer following surgical resection of said cancer, comprising a prediction of clinical outcome based on information comprising the expression level of one or more predictive RNA transcripts selected from the group consisting of CAPG, CD28, CKS1B, CYR61, DKK1, HSD17B2, LOX, MMP7, SIR2, ALCAM, CD24, CDC20, CDH11, CENPE, CLTC, EMR3, ICAM2, MADH2, MGAT5, MT3, NUFIP1, PRDX6, SOS1, STAT5B, TFF3, TMSB4X, TP53BP1, and WIF, or their expression products, in a biological sample comprising cancer cells obtained from said subject, wherein: (a) evidence of increased expression of one or more of the genes selected from the group consisting of CAPG, CD28, CKS1B, CYR61, DKK1, HSD17B2, LOX, MMP7, and SIR2, or the corresponding expression product, indicates a decreased likelihood of positive clinical outcome; and (b) evidence of increased expression of one or more of the genes selected from the group consisting of ALCAM, CD24, CDC20, CDH11, CENPE, CLTC, EMR3, ICAM2, MADH2, MGAT5, MT3, NUFIP1, PRDX6, SOS1, STAT5B, TFF3, TMSB4X, TP53BP1, and WIF, or the corresponding expression product, indicates an increased likelihood of positive clinical outcome. The prediction of clinical outcome may comprise an estimate of the likelihood of a particular clinical outcome for a subject or may comprise the classification of a subject into a risk group based on said estimate.

In a different aspect the invention concerns a kit comprising one or more of (1) extraction buffer/reagents and protocol; (2) reverse transcription buffer/reagents and protocol; and (3) qPCR buffer/reagents and protocol suitable for performing the methods of this invention. The kit may comprise data retrieval and analysis software.

DETAILED DESCRIPTION OF THE PREFERRED EMBODIMENT

A. Definitions

Figure 1:
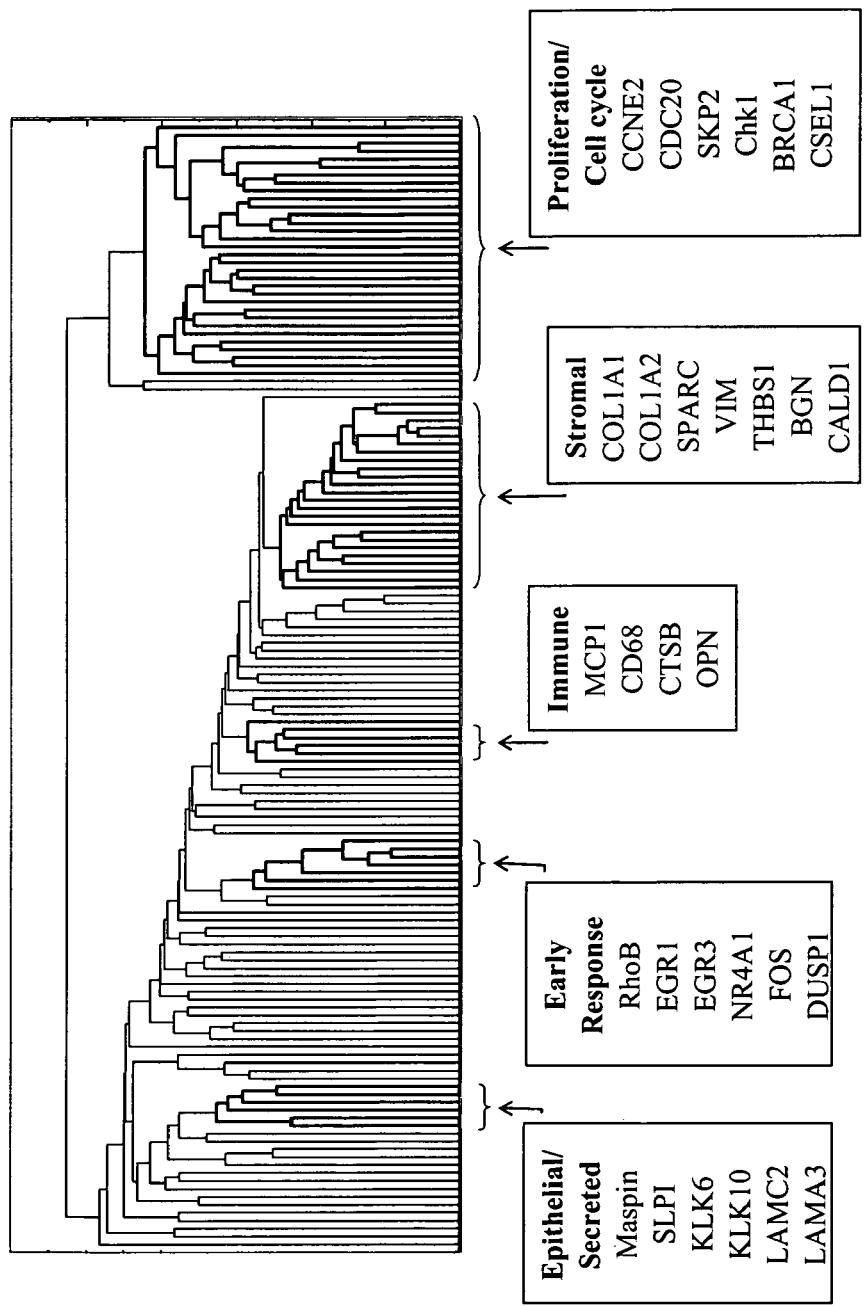
FIG. 1 shows a dendrogram representing the expression clustering of 142 genes that were statistically significantly related to recurrence-free interval (Tables 1.2A and 1.2B) in the univariate Cox proportional hazards analysis. The cluster analysis used the unweighted pair-group average amalgamation method and 1-Pearson r as the distance measure. The identities of particular genes in clusters of interest are indicated along the x-axis.

Unless defined otherwise, technical and scientific terms used herein have the same meaning as commonly understood by one of ordinary skill in the art to which this invention belongs. Singleton et al., Dictionary of Microbiology and Molecular Biology 2nd ed., J. Wiley & Sons (New York, N.Y. 1994), and March, Advanced Organic Chemistry Reactions, Mechanisms and Structure 4th ed., John Wiley & Sons (New York, N.Y. 1992), provide one skilled in the art with a general guide to many of the terms used in the present application.

One skilled in the art will recognize many methods and materials similar or equivalent to those described herein, which could be used in the practice of the present invention. Indeed, the present invention is in no way limited to the methods and materials described. For purposes of the present invention, the following terms are defined below.

The term "tumor," as used herein, refers to all neoplastic cell growth and proliferation, whether malignant or benign, and all pre-cancerous and cancerous cells and tissues.

The terms "cancer" and "cancerous" refer to or describe the physiological condition in mammals that is typically characterized by unregulated cell growth. Examples of cancer include, but are not limited to, breast cancer, ovarian cancer, colon cancer, lung cancer, prostate cancer, hepatocellular cancer, gastric cancer, pancreatic cancer, cervical cancer, liver cancer, bladder cancer, cancer of the urinary tract, thyroid cancer, renal cancer, carcinoma, melanoma, and brain cancer.

The "pathology" of cancer includes all phenomena that compromise the well-being of the patient. This includes, without limitation, abnormal or uncontrollable cell growth, metastasis, interference with the normal functioning of neighboring cells, release of cytokines or other secretory products at abnormal levels, suppression or aggravation of inflammatory or immunological response, neoplasia, premalignancy, malignancy, invasion of surrounding or distant tissues or organs, such as lymph nodes, etc.

The term "colorectal cancer" is used in the broadest sense and refers to (1) all stages and all forms of cancer arising from epithelial cells of the large intestine and/or rectum and/or (2) all stages and all forms of cancer affecting the lining of the large intestine and/or rectum. In the staging systems used for classification of colorectal cancer, the colon and rectum are treated as one organ.

According to the tumor, node, metastasis (TNM) staging system of the American Joint Committee on Cancer (AJCC) (Greene et al. (eds.), AJCC Cancer Staging Manual. 6th Ed. New York, N.Y.: Springer; 2002), the various stages of colorectal cancer are defined as follows:

Tumor: T1: tumor invades submucosa; T2: tumor invades muscularis propria; T3: tumor invades through the muscularis propria into the subserose, or into the pericolic or perirectal tissues; T4: tumor directly invades other organs or structures, and/or perforates.

Node: N0: no regional lymph node metastasis; N1: metastasis in 1 to 3 regional lymph nodes; N2: metastasis in 4 or more regional lymph nodes.

Metastasis: M0: mp distant metastasis; M1: distant metastasis present.

Stage groupings: Stage I: T1 N0 M0; T2 N0 M0; Stage II: T3 N0 M0; T4 N0 M0; Stage III: any T, N1-2; M0; Stage IV: any T, any N, M1.

According to the Modified Duke Staging System, the various stages of colorectal cancer are defined as follows:

Stage A: the tumor penetrates into the mucosa of the bowel wall but not further. Stage B: tumor penetrates into and through the muscularis propria of the bowel wall; Stage C: tumor penetrates into but not through muscularis propria of the bowel wall, there is pathologic evidence of colorectal cancer in the lymph nodes; or tumor penetrates into and through the muscularis propria of the bowel wall, there is pathologic evidence of cancer in the lymph nodes; Stage D: tumor has spread beyond the confines of the lymph nodes, into other organs, such as the liver, lung or bone.

Prognostic factors are those variables related to the natural history of colorectal cancer, which influence the recurrence rates and outcome of patients once they have developed colorectal cancer. Clinical parameters that have been associated with a worse prognosis include, for example, lymph node involvement, and high grade tumors. Prognostic factors are frequently used to categorize patients into subgroups with different baseline relapse risks.

The term "prognosis" is used herein to refer to the prediction of the likelihood of cancer-attributable death or progression, including recurrence, metastatic spread, and drug resistance, of a neoplastic disease, such as colon cancer.

The term "prediction" is used herein to refer to the likelihood that a patient will have a particular clinical outcome, whether positive or negative, following surgical removal of the primary tumor. The predictive methods of the present invention can be used clinically to make treatment decisions by choosing the most appropriate treatment modalities for any particular patient. The predictive methods of the present invention are valuable tools in predicting if a patient is likely to respond favorably to a treatment regimen, such as surgical intervention. The prediction may include prognostic factors.

The term "positive clinical outcome" means an improvement in any measure of patient status, including those measures ordinarily used in the art, such as an increase in the duration of Recurrence-Free interval (RFI), an increase in the time of Overall Survival (OS), an increase in the time of Disease-Free Survival (DFS), an increase in the duration of Distant Recurrence-Free Interval (DRFI), and the like. An increase in the likelihood of positive clinical outcome corresponds to a decrease in the likelihood of cancer recurrence.

The term "risk classification" means the level of risk or the prediction that a subject will experience a particular clinical outcome. A subject may be classified into a risk group or classified at a level of risk based on the predictive methods of the present invention. A "risk group" is a group of subjects or individuals with a similar level of risk for a particular clinical outcome.

The term "long-term" survival is used herein to refer to survival for at least 3 years, more preferably for at least 5 years.

The term "Recurrence-Free Interval (RFI)" is used herein to refer to time in years to first colon cancer recurrence censoring for second primary cancer as a first event or death without evidence of recurrence.

The term "Overall Survival (OS)" is used herein to refer to time in years from surgery to death from any cause.

The term "Disease-Free Survival (DFS)" is used herein to refer to time in years to colon cancer recurrence or death from any cause.

The term "Distant Recurrence-Free Interval (DRFI)" is used herein to refer to the time (in years) from surgery to the first anatomically distant cancer recurrence.

The calculation of the measures listed above in practice may vary from study to study depending on the definition of events to be either censored or not considered.

The term "microarray" refers to an ordered arrangement of hybridizable array elements, preferably polynucleotide probes, on a substrate.

The term "polynucleotide," when used in singular or plural, generally refers to any polyribonucleotide or polydeoxyribonucleotide, which may be unmodified RNA or DNA or modified RNA or DNA. Thus, for instance, polynucleotides as defined herein include, without limitation, single- and double-stranded DNA, DNA including single- and double-stranded regions, single- and double-stranded RNA, and RNA including single- and double-stranded regions, hybrid molecules comprising DNA and RNA that may be single-stranded or, more typically, double-stranded or include single- and double-stranded regions. In addition, the term "polynucleotide" as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. The term "polynucleotide" specifically includes cDNAs. The term includes DNAs (including cDNAs) and RNAs that contain one or more modified bases. Thus, DNAs or RNAs with backbones modified for stability or for other reasons are "polynucleotides" as that term is intended herein. Moreover, DNAs or RNAs comprising unusual bases, such as inosine, or modified bases, such as tritiated bases, are included within the term "polynucleotides" as defined herein. In general, the term "polynucleotide" embraces all chemically, enzymatically and/or metabolically modified forms of unmodified polynucleotides, as well as the chemical forms of DNA and RNA characteristic of viruses and cells, including simple and complex cells.

The term "oligonucleotide" refers to a relatively short polynucleotide, including, without limitation, single-stranded deoxyribonucleotides, single- or double-stranded ribonucleotides, RNA:DNA hybrids and double-stranded DNAs. Oligonucleotides, such as single-stranded DNA probe oligonucleotides, are often synthesized by chemical methods, for example using automated oligonucleotide synthesizers that are commercially available. However, oligonucleotides can be made by a variety of other methods, including in vitro recombinant DNA-mediated techniques and by expression of DNAs in cells and organisms.

The terms "differentially expressed gene," "differential gene expression" and their synonyms, which are used interchangeably, refer to a gene whose expression is activated to a higher or lower level in a subject suffering from a disease, specifically cancer, such as colon cancer, relative to its expression in a normal or control subject. The terms also include genes whose expression is activated to a higher or lower level at different stages of the same disease. It is also understood that a differentially expressed gene may be either activated or inhibited at the nucleic acid level or protein level, or may be subject to alternative splicing to result in a different polypeptide product. Such differences may be evidenced by a change in mRNA levels, surface expression, secretion or other partitioning of a polypeptide, for example. Differential gene expression may include a comparison of expression between two or more genes or their gene products, or a comparison of the ratios of the expression between two or more genes or their gene products, or even a comparison of two differently processed products of the same gene, which differ between normal subjects and subjects suffering from a disease, specifically cancer, or between various stages of the same disease. Differential expression includes both quantitative, as well as qualitative, differences in the temporal or cellular expression pattern in a gene or its expression products among, for example, normal and diseased cells, or among cells which have undergone different disease events or disease stages. For the purpose of this invention, "differential gene expression" is considered to be present when there is at least an about two-fold, preferably at least about four-fold, more preferably at least about six-fold, most preferably at least about ten-fold difference between the expression of a given gene in normal and diseased subjects, or in various stages of disease development in a diseased subject.

The term "over-expression" with regard to an RNA transcript is used to refer to the level of the transcript determined by normalization to the level of reference mRNAs, which might be all measured transcripts in the specimen or a particular reference set of mRNAs.

The phrase "gene amplification" refers to a process by which multiple copies of a gene or gene fragment are formed in a particular cell or cell line. The duplicated region (a stretch of amplified DNA) is often referred to as "amplicon." Usually, the amount of the messenger RNA (mRNA) produced, i.e., the level of gene expression, also increases in the proportion of the number of copies made of the particular gene expressed.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to reanneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., *Current Protocols in Molecular Biology*, Wiley Interscience Publishers, (1995).

"Stringent conditions" or "high stringency conditions", as defined herein, typically: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide, followed by a high-stringency wash consisting of 0.1×SSC containing EDTA at 55° C.

"Moderately stringent conditions" may be identified as described by Sambrook et al., *Molecular Cloning: A Laboratory Manual*, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C. The skilled artisan will recognize how to adjust the temperature, ionic strength, etc. as necessary to accommodate factors such as probe length and the like.

In the context of the present invention, reference to "at least one," "at least two," "at least five," etc. of the genes listed in any particular gene set means any one or any and all combinations of the genes listed.

The term "node negative" cancer, such as "node negative" colon cancer, is used herein to refer to cancer that has not spread to the lymph nodes.

The terms "splicing" and "RNA splicing" are used interchangeably and refer to RNA processing that removes introns and joins exons to produce mature mRNA with continuous coding sequence that moves into the cytoplasm of an eukaryotic cell.

In theory, the term "exon" refers to any segment of an interrupted gene that is represented in the mature RNA product (B. Lewin. *Genes IV* Cell Press, Cambridge Mass. 1990). In theory the term "intron" refers to any segment of DNA that is transcribed but removed from within the transcript by splicing together the exons on either side of it. Operationally, exon sequences occur in the mRNA sequence of a gene as defined by Ref. SEQ ID numbers. Operationally, intron sequences are the intervening sequences within the genomic DNA of a gene, bracketed by exon sequences and having GT and AG splice consensus sequences at their 5' and 3' boundaries.

The term "expression cluster" is used herein to refer to a group of genes which demonstrate similar expression patterns when studied within samples from a defined set of patients. As used herein, the genes within an expression cluster show similar expression patterns when studied within samples from patients with Stage II and/or Stage III cancers of the colon and/or rectum.

B.1 General Description of the Invention

The practice of the present invention will employ, unless otherwise indicated, conventional techniques of molecular biology (including recombinant techniques), microbiology, cell biology, and biochemistry, which are within the skill of the art. Such techniques are explained fully in the literature, such as, "Molecular Cloning: A Laboratory Manual", $2^{nd}$ edition (Sambrook et al., 1989); "Oligonucleotide Synthesis" (M. J. Gait, ed., 1984); "Animal Cell Culture" (R. I. Freshney, ed., 1987); "Methods in Enzymology" (Academic Press, Inc.); "Handbook of Experimental Immunology", $4^{th}$ edition (D. M. Weir & C. C. Blackwell, eds., Blackwell Science Inc., 1987); "Gene Transfer Vectors for Mammalian Cells" (J. M. Miller & M. P. Calos, eds., 1987); "Current Protocols in Molecular Biology" (F. M. Ausubel et al., eds., 1987); and "PCR: The Polymerase Chain Reaction", (Mullis et al., eds., 1994).

Based on evidence of differential expression of RNA transcripts in normal and cancer cells, the present invention provides prognostic gene markers for colorectal cancer. Thus, in a particular aspect, the invention provides prognostic gene markers of Stage II and/or Stage III colorectal cancer, including markers that are specifically prognostic to the outcome of either Stage II or Stage III disease and those that have prognostic value at both stages, reflecting underlying differences in tumor cells in the two stages and/or in the extent of tumor progression. The prognostic markers and associated information provided by the present invention allow physicians to make more intelligent treatment decisions, and to customize the treatment of colorectal cancer to the needs of individual patients, thereby maximizing the benefit of treatment and minimizing the exposure of patients to unnecessary treatments, which do not provide any significant benefits and often carry serious risks due to toxic side-effects.

Disruptions in the normal functioning of various physiological processes, including proliferation, apoptosis, angiogenesis and invasion, have been implicated in the pathology in cancer. The relative contribution of dysfunctions in particular physiological processes to the pathology of particular cancer types is not well characterized. Any physiological process integrates the contributions of numerous gene products expressed by the various cells involved in the process. For example, tumor cell invasion of adjacent normal tissue and intravasation of the tumor cell into the circulatory system are effected by an array of proteins that mediate various cellular characteristics, including cohesion among tumor cells, adhesion of tumor cells to normal cells and connective tissue, ability of the tumor cell first to alter its morphology and then to migrate through surrounding tissues, and ability of the tumor cell to degrade surrounding connective tissue structures.

Multi-analyte gene expression tests can measure the expression level of one or more genes involved in each of several relevant physiologic processes or component cellular characteristics. In some instances the predictive power of the test, and therefore its utility, can be improved by using the expression values obtained for individual genes to calculate a score which is more highly correlated with outcome than is the expression value of the individual genes. For example, the calculation of a quantitative score (recurrence score) that predicts the likelihood of recurrence in estrogen receptor-positive, node-negative breast cancer is describe in a co-pending U.S. patent application (Publication Number 20050048542). The equation used to calculate such a recurrence score may group genes in order to maximize the predictive value of the recurrence score. The grouping of genes may be performed at least in part based on knowledge of their contribution to physiologic functions or component cellular characteristics such as discussed above. The formation of groups, in addition, can facilitate the mathematical weighting of the contribution of various expression values to the recurrence score. The weighting of a gene group representing a physiological process or component cellular characteristic can reflect the contribution of that process or characteristic to the pathology of the cancer and clinical outcome. Accordingly, in an important aspect, the present invention also provides specific groups of the prognostic genes identified herein, that together are more reliable and powerful predictors of outcome than the individual genes or random combinations of the genes identified.

In addition, based on the determination of a recurrence score, one can choose to partition patients into subgroups at any particular value(s) of the recurrence score, where all patients with values in a given range can be classified as belonging to a particular risk group. Thus, the values chosen will define subgroups of patients with respectively greater or lesser risk.

The utility of a gene marker in predicting colon cancer outcome may not be unique to that marker. An alternative marker having a expression pattern that is closely similar to a particular test marker may be substituted for or used in addition to a test marker and have little impact on the overall predictive utility of the test. The closely similar expression patterns of two genes may result from involvement of both genes in a particular process and/or being under common regulatory control in colon tumor cells. The present invention specifically includes and contemplates the use of such substitute genes or gene sets in the methods of the present invention.

The prognostic markers and associated information provided by the present invention predicting the clinical outcome in Stage II and/or Stage III cancers of the colon and/or rectum has utility in the development of drugs to treat Stage II and/or Stage III cancers of the colon and/or rectum.

The prognostic markers and associated information provided by the present invention predicting the clinical outcome in Stage II and/or Stage III cancers of the colon and/or rectum also have utility in screening patients for inclusion in clinical trials that test the efficacy of drug compounds for the treatment of patients with Stage II and/or Stage III cancers of the colon and/or rectum. In particular the prognostic markers may be used on samples collected from patients in a clinical trial and the results of the test used in conjunction with patient outcomes in order to determine whether subgroups of patients are more or less likely to show a response to the drug than the whole group or other subgroups.

The prognostic markers and associated information provided by the present invention predicting the clinical outcome in Stage II and/or Stage III cancers of the colon and/or rectum are useful as inclusion criterion for a clinical trial. For example, a patient is more likely to be included in a clinical trial if the results of the test indicate a higher likelihood that the patient will have a poor clinical outcome if treated with surgery alone and a patient is less likely to be included in a clinical trial if the results of the test indicate a lower likelihood that the patient will have a poor clinical outcome if treated with surgery alone.

In a particular embodiment, prognostic markers and associated information are used to design or produce a reagent that modulates the level or activity of the gene's transcript or its expression product. Said reagents may include but are not limited to an antisense RNA, a small inhibitory RNA, a ribozyme, a monoclonal or polyclonal antibody.

In a further embodiment, said gene or its transcript, or more particularly, an expression product of said transcript is used in an (screening) assay to identify a drug compound, wherein said drug compounds is used in the development of a drug to treat Stage II and/or Stage III cancers of the colon and/or rectum.

In various embodiments of the inventions, various technological approaches are available for determination of expression levels of the disclosed genes, including, without limitation, RT-PCR, microarrays, serial analysis of gene expression (SAGE) and Gene Expression Analysis by Massively Parallel Signature Sequencing (MPSS), which will be discussed in detail below. In particular embodiments, the expression level of each gene may be determined in relation to various features of the expression products of the gene including exons, introns, protein epitopes and protein activity. In other embodiments, the expression level of a gene may be inferred from analysis of the structure of the gene, for example from the analysis of the methylation pattern of gene's promoter(s).

B.2 Gene Expression Profiling

Methods of gene expression profiling include methods based on hybridization analysis of polynucleotides, methods based on sequencing of polynucleotides, and proteomics-based methods. The most commonly used methods known in the art for the quantification of mRNA expression in a sample include northern blotting and in situ hybridization (Parker & Barnes, Methods in Molecular Biology 106:247-283 (1999)); RNAse protection assays (Hod, Biotechniques 13:852-854 (1992)); and PCR-based methods, such as reverse transcription polymerase chain reaction (RT-PCR) (Weis et al., Trends in Genetics 8:263-264 (1992)). Alternatively, antibodies may be employed that can recognize sequence-specific duplexes, including DNA duplexes, RNA duplexes, and DNA-RNA hybrid duplexes or DNA-protein duplexes. Representative methods for sequencing-based gene expression analysis include Serial Analysis of Gene Expression (SAGE), and gene expression analysis by massively parallel signature sequencing (MPSS).

a. Reverse Transcriptase PCR (RT-PCR)

Of the techniques listed above, the most sensitive and most flexible quantitative method is RT-PCR, which can be used to determine mRNA levels in various samples. The results can be used to compare gene expression patterns between sample sets, for example in normal and tumor tissues and in patients with or without drug treatment.

The first step is the isolation of mRNA from a target sample. The starting material is typically total RNA isolated from human tumors or tumor cell lines, and corresponding normal tissues or cell lines, respectively. Thus RNA can be isolated from a variety of primary tumors, including breast, lung, colon, prostate, brain, liver, kidney, pancreas, spleen, thymus, testis, ovary, uterus, etc., tumor, or tumor cell lines, with pooled DNA from healthy donors. If the source of mRNA is a primary tumor, mRNA can be extracted, for example, from frozen or archived paraffin-embedded and fixed (e.g. formalin-fixed) tissue samples.

General methods for mRNA extraction are well known in the art and are disclosed in standard textbooks of molecular biology, including Ausubel et al., *Current Protocols of Molecular Biology*, John Wiley and Sons (1997). Methods for RNA extraction from paraffin embedded tissues are disclosed, for example, in Rupp and Locker, *Lab Invest*. 56:A67 (1987), and De Andrés et al., *BioTechniques* 18:42044 (1995). In particular, RNA isolation can be performed using purification kit, buffer set and protease from commercial manufacturers, such as Qiagen, according to the manufacturer's instructions. For example, total RNA from cells in culture can be isolated using Qiagen RNeasy mini-columns. Other commercially available RNA isolation kits include Master-Pure™ Complete DNA and RNA Purification Kit (EPICENTRE®, Madison, Wis.), and Paraffin Block RNA Isolation Kit (Ambion, Inc.). Total RNA from tissue samples can be isolated using RNA Stat-60 (Tel-Test). RNA prepared from tumor can be isolated, for example, by cesium chloride density gradient centrifugation.

As RNA cannot serve as a template for PCR, the first step in gene expression profiling by RT-PCR is the reverse transcription of the RNA template into cDNA, followed by its exponential amplification in a PCR reaction. The two most commonly used reverse transcriptases are avilo myeloblastosis virus reverse transcriptase (AMV-RT) and Moloney murine leukemia virus reverse transcriptase (MMLV-RT). The reverse transcription step is typically primed using specific primers, random hexamers, or oligo-dT primers, depending on the circumstances and the goal of expression profiling. For example, extracted RNA can be reverse-transcribed using a GeneAmp RNA PCR kit (Perkin Elmer, CA, USA), following the manufacturer's instructions. The derived cDNA can then be used as a template in the subsequent PCR reaction.

Although the PCR step can use a variety of thermostable DNA-dependent DNA polymerases, it typically employs the Taq DNA polymerase, which has a 5'-3' nuclease activity but lacks a 3'-5' proofreading endonuclease activity. Thus, TaqMan® PCR typically utilizes the 5'-nuclease activity of Taq or Tth polymerase to hydrolyze a hybridization probe bound to its target amplicon, but any enzyme with equivalent 5' nuclease activity can be used. Two oligonucleotide primers are used to generate an amplicon typical of a PCR reaction. A third oligonucleotide, or probe, is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

TaqMan® RT-PCR can be performed using commercially available equipment, such as, for example, ABI PRISM 7700™ Sequence Detection System™ (Perkin-Elmer-Applied Biosystems, Foster City, Calif., USA), or Lightcycler (Roche Molecular Biochemicals, Mannheim, Germany). In a preferred embodiment, the 5' nuclease procedure is run on a real-time quantitative PCR device such as the ABI PRISM 7700™ Sequence Detection System™. The system consists of a thermocycler, laser, charge-coupled device (CCD), camera and computer. The system amplifies samples in a 96-well format on a thermocycler. During amplification, laser-induced fluorescent signal is collected in real-time through fiber optics cables for all 96 wells, and detected at the CCD. The system includes software for running the instrument and for analyzing the data.

5'-Nuclease assay data are initially expressed as Ct, or the threshold cycle. As discussed above, fluorescence values are recorded during every cycle and represent the amount of product amplified to that point in the amplification reaction. The point when the fluorescent signal is first recorded as statistically significant is the threshold cycle ($C_t$).

To minimize errors and the effect of sample-to-sample variation, RT-PCR is usually performed using an internal standard. The ideal internal standard is expressed at a constant level among different tissues, and is unaffected by the experimental treatment. RNAs most frequently used to normalize patterns of gene expression are mRNAs for the housekeeping genes glyceraldehyde-3-phosphate-dehydrogenase (GAPDH) and β-actin.

A more recent variation of the RT-PCR technique is the real time quantitative PCR, which measures PCR product accumulation through a dual-labeled fluorigenic probe (i.e., TaqMan® probe). Real time PCR is compatible both with quantitative competitive PCR, where internal competitor for each target sequence is used for normalization, and with quantitative comparative PCR using a normalization gene contained within the sample, or a housekeeping gene for RT-PCR. For further details see, e.g. Held et al., *Genome Research* 6:986-994 (1996).

The steps of a representative protocol for profiling gene expression using fixed, paraffin-embedded tissues as the RNA source, including mRNA isolation, purification, primer extension and amplification are given in various published journal articles (for example: T. E. Godfrey et al. J. Molec. Diagnostics 2: 84-91 (2000); K. Specht et al., Am. J. Pathol. 158: 419-29 (2001)). Briefly, a representative process starts with cutting about 10 μm thick sections of paraffin-embedded tumor tissue samples. The RNA is then extracted, and protein and DNA are removed. After analysis of the RNA concentration, RNA repair and/or amplification steps may be included, if necessary, and RNA is reverse transcribed using gene specific promoters followed by RT-PCR.

b. MassARRAY System

In the MassARRAY-based gene expression profiling method, developed by Sequenom, Inc. (San Diego, Calif.) following the isolation of RNA and reverse transcription, the obtained cDNA is spiked with a synthetic DNA molecule (competitor), which matches the targeted cDNA region in all positions, except a single base, and serves as an internal standard. The cDNA/competitor mixture is PCR amplified and is subjected to a post-PCR shrimp alkaline phosphatase (SAP) enzyme treatment, which results in the dephosphorylation of the remaining nucleotides. After inactivation of the alkaline phosphatase, the PCR products from the competitor and cDNA are subjected to primer extension, which generates distinct mass signals for the competitor- and cDNA-derives PCR products. After purification, these products are dispensed on a chip array, which is pre-loaded with components needed for analysis with matrix-assisted laser desorption ionization time-of-flight mass spectrometry (MALDI-TOF MS) analysis. The cDNA present in the reaction is then quantified by analyzing the ratios of the peak areas in the mass spectrum generated. For further details see, e.g. Ding and Cantor, Proc. Natl. Acad. Sci. USA 100:3059-3064 (2003).

c. Other PCR-Based Methods

Further PCR-based techniques include, for example, differential display (Liang and Pardee, Science 257:967-971 (1992)); amplified fragment length polymorphism (iAFLP) (Kawamoto et al., Genome Res. 12:1305-1312 (1999)); BeadArray™ technology (Illumina, San Diego, Calif.; Oliphant et al., Discovery of Markers for Disease (Supplement to Biotechniques), June 2002; Ferguson et al., Analytical Chemistry 72:5618 (2000)); BeadsArray for Detection of Gene Expression (BADGE), using the commercially available Luminex100 LabMAP system and multiple color-coded microspheres (Luminex Corp., Austin, Tex.) in a rapid assay for gene expression (Yang et al., Genome Res. 11:1888-1898 (2001)); and high coverage expression profiling (HiCEP) analysis (Fukumura et al., Nucl. Acids. Res. 31(16) e94 (2003)).

d. Microarrays

Differential gene expression can also be identified, or confirmed using the microarray technique. Thus, the expression profile of colon cancer-associated genes can be measured in either fresh or paraffin-embedded tumor tissue, using microarray technology. In this method, polynucleotide sequences of interest (including cDNAs and oligonucleotides) are plated, or arrayed, on a microchip substrate. The arrayed sequences are then hybridized with specific DNA probes from cells or tissues of interest. Just as in the RT-PCR method, the source of mRNA typically is total RNA isolated from human tumors or tumor cell lines, and corresponding normal tissues or cell lines. Thus RNA can be isolated from a variety of primary tumors or tumor cell lines. If the source of mRNA is a primary tumor, mRNA can be extracted, for example, from frozen or archived paraffin-embedded and fixed (e.g. formalin-fixed) tissue samples, which are routinely prepared and preserved in everyday clinical practice.

In a specific embodiment of the microarray technique, PCR amplified inserts of cDNA clones are applied to a substrate in a dense array. Preferably at least 10,000 nucleotide sequences are applied to the substrate. The microarrayed genes, immobilized on the microchip at 10,000 elements each, are suitable for hybridization under stringent conditions. Fluorescently labeled cDNA probes may be generated through incorporation of fluorescent nucleotides by reverse transcription of RNA extracted from tissues of interest. Labeled cDNA probes applied to the chip hybridize with specificity to each spot of DNA on the array. After stringent washing to remove non-specifically bound probes, the chip is scanned by confocal laser microscopy or by another detection method, such as a CCD camera. Quantitation of hybridization of each arrayed element allows for assessment of corresponding mRNA abundance. With dual color fluorescence, separately labeled cDNA probes generated from two sources of RNA are hybridized pair wise to the array. The relative abundance of the transcripts from the two sources corresponding to each specified gene is thus determined simultaneously. The miniaturized scale of the hybridization affords a convenient and rapid evaluation of the expression pattern for large numbers of genes. Such methods have been shown to have the sensitivity required to detect rare transcripts, which are expressed at a few copies per cell, and to reproducibly detect at least approximately two-fold differences in the expression levels (Schena et al., *Proc. Natl. Acad. Sci. USA* 93(2):106-149 (1996)). Microarray analysis can be performed by commercially available equipment, following manufacturer's protocols, such as by using the Affymetrix GenChip technology, or Incyte's microarray technology.

The development of microarray methods for large-scale analysis of gene expression makes it possible to search systematically for molecular markers of cancer classification and outcome prediction in a variety of tumor types.

e. Serial Analysis of Gene Expression (SAGE)

Serial analysis of gene expression (SAGE) is a method that allows the simultaneous and quantitative analysis of a large number of gene transcripts, without the need of providing an individual hybridization probe for each transcript. First, a short sequence tag (about 10-14 bp) is generated that contains sufficient information to uniquely identify a transcript, provided that the tag is obtained from a unique position within each transcript. Then, many transcripts are linked together to form long serial molecules, that can be sequenced, revealing the identity of the multiple tags simultaneously. The expression pattern of any population of transcripts can be quantitatively evaluated by determining the abundance of individual tags, and identifying the gene corresponding to each tag. For more details see, e.g. Velculescu et al., *Science* 270:484-487 (1995); and Velculescu et al., *Cell* 88:243-51 (1997).

f. Gene Expression Analysis by Massively Parallel Signature Sequencing (MPSS)

This method, described by Brenner et al., *Nature Biotechnology* 18:630-634 (2000), is a sequencing approach that combines non-gel-based signature sequencing with in vitro cloning of millions of templates on separate 5 μm diameter microbeads. First, a microbead library of DNA templates is constructed by in vitro cloning. This is followed by the assembly of a planar array of the template-containing microbeads in a flow cell at a high density (typically greater than $3 \times 10^6$ microbeads/cm$^2$). The free ends of the cloned templates on each microbead are analyzed simultaneously, using a fluorescence-based signature sequencing method that does not require DNA fragment separation. This method has been shown to simultaneously and accurately provide, in a single operation, hundreds of thousands of gene signature sequences from a yeast cDNA library.

g. Immunohistochemistry

Immunohistochemistry methods are also suitable for detecting the expression levels of the prognostic markers of the present invention. Thus, antibodies or antisera, preferably polyclonal antisera, and most preferably monoclonal antibodies specific for each marker are used to detect expression. The antibodies can be detected by direct labeling of the antibodies themselves, for example, with radioactive labels, fluorescent labels, hapten labels such as, biotin, or an enzyme such as horse radish peroxidase or alkaline phosphatase.

Alternatively, unlabeled primary antibody is used in conjunction with a labeled secondary antibody, comprising antisera, polyclonal antisera or a monoclonal antibody specific for the primary antibody. Immunohistochemistry protocols and kits are well known in the art and are commercially available.

h. Proteomics

The term "proteome" is defined as the totality of the proteins present in a sample (e.g. tissue, organism, or cell culture) at a certain point of time. Proteomics includes, among other things, study of the global changes of protein expression in a sample (also referred to as "expression proteomics"). Proteomics typically includes the following steps: (1) separation of individual proteins in a sample by 2-D gel electrophoresis (2-D PAGE); (2) identification of the individual proteins recovered from the gel, e.g. my mass spectrometry or N-terminal sequencing, and (3) analysis of the data using bioinformatics. Proteomics methods are valuable supplements to other methods of gene expression profiling, and can be used, alone or in combination with other methods, to detect the products of the prognostic markers of the present invention.

i. Promoter Methylation Analysis

A number of methods for quantization of RNA transcripts (gene expression analysis) or their protein translation products are discussed herein. The expression level of genes may also be inferred from information regarding chromatin structure, such as for example the methylation status of gene promoters and other regulatory elements and the acetylation status of histones.

In particular, the methylation status of a promoter influences the level of expression of the gene regulated by that promoter. Aberrant methylation of particular gene promoters has been implicated in expression regulation, such as for example silencing of tumor suppressor genes. Thus, examination of the methylation status of a gene's promoter can be utilized as a surrogate for direct quantization of RNA levels.

Several approaches for measuring the methylation status of particular DNA elements have been devised, including methylation-specific PCR (Herman J. G. et al. (1996) Methylation-specific PCR: a novel PCR assay for methylation status of CpG islands. Proc. Natl Acad. Sci. USA. 93, 9821-9826.) and bisulfite DNA sequencing (Frommer M. et al. (1992) A genomic sequencing protocol that yields a positive display of 5-methylcytosine residues in individual DNA strands. Proc. Natl Acad. Sci. USA. 89, 1827-1831.). More recently, microarray-based technologies have been used to characterize promoter methylation status (Chen C. M. (2003) Methylation target array for rapid analysis of CpG island hypermethylation in multiple tissue genomes. Am. J. Pathol. 163, 3745.).

j. Coexpression of Genes

A further aspect of the invention is the identification of gene expression clusters. Gene expression clusters can be identified by analysis of expression data using statistical analyses known in the art, including pairwise analysis of correlation based on Pearson correlation coefficients (Pearson K. and Lee A. (1902) *Biometrika* 2, 357).

In one embodiment, an expression cluster identified herein includes BGN, CALD1, COL1A1, COL1A2, SPARC, VIM and other genes which are known to be synthesized predominantly by stromal cells and to be involved in remodeling extracellular matrix. This expression cluster is referred to herein as the Extracellular Matrix Remodeling/Stromal cluster.

In another embodiment, an expression cluster identified herein includes ANXA2, KLK6, KLK10, LAMA3, LAMC2, MASPIN, SLPI, and other genes encoding epithelial cell secreted products, most of which are secreted predominantly by epithelial cells but which may be secreted by other cell types. This expression cluster is referred to herein as the Epithelial/Secreted cluster.

In still another embodiment, an expression cluster identified herein includes DUSP1, EGR1, EGR3, FOS, NR4A1, RHOB, and other genes whose transcription is upregulated early after exposure of cells to certain stimuli. A variety of stimuli trigger transcription of early response genes, e.g. exposure to growth factor s, which enables cells to quickly increase their motility and their ability to transport nutrients such as glucose. This expression cluster is referred to herein as the Early Response cluster.

In yet another embodiment, an expression cluster identified herein includes MCP1, CD68, CTSB, OPN, and other genes encoding proteins usually associated with cells of the immune system. This expression cluster is referred to herein as the Immune cluster.

In a further embodiment, an expression cluster identified herein includes CCNE2, CDC20, SKP2, CHK1, BRCA1, CSEL1 and other genes implicated in cell proliferation and regulation of the cell cycle. This expression cluster is referred to herein as the Proliferation/Cell Cycle cluster.

k. General Description of the mRNA Isolation, Purification and Amplification

The steps of a representative protocol for profiling gene expression using fixed, paraffin-embedded tissues as the RNA source, including mRNA isolation, purification, primer extension and amplification are provided in various published journal articles (for example: T. E. Godfrey et al., *J. Molec. Diagnostics* 2: 84-91 (2000); K. Specht et al., *Am. J. Pathol.* 158: 419-29 (2001)). Briefly, a representative process starts with cutting about 10 μm thick sections of paraffin-embedded tumor tissue samples. The RNA is then extracted, and protein and DNA are removed. After analysis of the RNA concentration, RNA repair and/or amplification steps may be included, if necessary, and RNA is reverse transcribed using gene specific promoters followed by RT-PCR. Finally, the data are analyzed to identify the best treatment option(s) available to the patient on the basis of the characteristic gene expression pattern identified in the tumor sample examined, dependent on the predicted likelihood of cancer recurrence.

l. Colon Cancer Gene Set, Assayed Gene Subsequences, and Clinical Application of Gene Expression Data An important aspect of the present invention is to use the measured expression of certain genes by colon cancer tissue to provide prognostic information. For this purpose it is necessary to correct for (normalize away) both differences in the amount of RNA assayed and variability in the quality of the RNA used. Therefore, the assay typically measures and incorporates the expression of certain normalizing genes, including well known housekeeping genes, such as GAPDH and Cyp1. Alternatively, normalization can be based on the mean or median signal (Ct) of all of the assayed genes or a large subset thereof (global normalization approach). On a gene-by-gene basis, measured normalized amount of a patient tumor mRNA is compared to the amount found in a colon cancer tissue reference set. The number (N) of colon cancer tissues in this reference set should be sufficiently high to ensure that different reference sets (as a whole) behave essentially the same way. If this condition is met, the identity of the individual colon cancer tissues present in a particular set will have no significant impact on the relative amounts of the genes assayed. Usually, the colon cancer tissue reference set consists of at least about 30, preferably at least about 40 different FPE colon cancer tissue specimens. Unless noted otherwise, normalized expression levels for each mRNA/tested tumor/patient will be expressed as a percentage of the expression level measured in the reference set. More specifically, the reference set of a sufficiently high number (e.g. 40) of tumors yields a distribution of normalized levels of each mRNA species. The level measured in a particular tumor sample to be analyzed falls at some percentile within this range, which can be determined by methods well known in the art. Below, unless noted otherwise, reference to expression levels of a gene assume normalized expression relative to the reference set although this is not always explicitly stated.

m. Design of Intron-Based PCR Primers and Probes

According to one aspect of the present invention, PCR primers and probes are designed based upon intron sequences present in the gene to be amplified. Accordingly, the first step in the primer/probe design is the delineation of intron sequences within the genes. This can be done by publicly available software, such as the DNA BLAT software developed by Kent, W. J., *Genome Res.* 12(4):656-64 (2002), or by the BLAST software including its variations. Subsequent steps follow well established methods of PCR primer and probe design.

In order to avoid non-specific signals, it is important to mask repetitive sequences within the introns when designing the primers and probes. This can be easily accomplished by using the Repeat Masker program available on-line through the Baylor College of Medicine, which screens DNA sequences against a library of repetitive elements and returns a query sequence in which the repetitive elements are masked. The masked intron sequences can then be used to design primer and probe sequences using any commercially or otherwise publicly available primer/probe design packages, such as Primer Express (Applied Biosystems); MGB assay-by-design (Applied Biosystems); Primer3 (Steve Rozen and Helen J. Skaletsky (2000) Primer3 on the WWW for general users and for biologist programmers. In: Krawetz S, Misener S (eds) *Bioinformatics Methods and Protocols: Methods in Molecular Biology*. Humana Press, Totowa, N.J., pp 365-386).

The most important factors considered in PCR primer design include primer length, melting temperature (Tm), and G/C content, specificity, complementary primer sequences, and 3'-end sequence. In general, optimal PCR primers are generally 17-30 bases in length, and contain about 20-80%, such as, for example, about 50-60% G+C bases. Tm's between 50 and 80° C., e.g. about 50 to 70° C. are typically preferred.

For further guidelines for PCR primer and probe design see, e.g. Dieffenbach, C. W. et al., "General Concepts for PCR Primer Design" in: *PCR Primer, A Laboratory Manual*, Cold Spring Harbor Laboratory Press, New York, 1995, pp. 133-155; Innis and Gelfand, "Optimization of PCRs" in: *PCR Protocols, A Guide to Methods and Applications*, CRC Press, London, 1994, pp. 5-11; and Plasterer, T. N. Primerselect: Primer and probe design. *Methods Mol. Biol.* 70:520-527 (1997), the entire disclosures of which are hereby expressly incorporated by reference.

n. Kits of the Invention

The materials for use in the methods of the present invention are suited for preparation of kits produced in accordance with well known procedures. The invention thus provides kits comprising agents, which may include gene-specific or gene-selective probes and/or primers, for quantitating the expression of the disclosed genes for predicting prognostic outcome or response to treatment. Such kits may optionally contain reagents for the extraction of RNA from tumor samples, in particular fixed paraffin-embedded tissue samples and/or reagents for RNA amplification. In addition, the kits may optionally comprise the reagent(s) with an identifying description or label or instructions relating to their use in the methods of the present invention. The kits may comprise containers (including microtiter plates suitable for use in an automated implementation of the method), each with one or more of the various reagents (typically in concentrated form) utilized in the methods, including, for example, pre-fabricated microarrays, buffers, the appropriate nucleotide triphosphates (e.g., dATP, dCTP, dGTP and dTTP; or rATP, rCTP, rGTP and UTP), reverse transcriptase, DNA polymerase, RNA polymerase, and one or more probes and primers of the present invention (e.g., appropriate length poly(T) or random primers linked to a promoter reactive with the RNA polymerase). Mathematical algorithms used to estimate or quantify prognostic or predictive information are also properly potential components of kits.

o. Reports of the Invention

The methods of this invention, when practiced for commercial diagnostic purposes generally produce a report or summary of the normalized expression levels of one or more of the selected genes. The methods of this invention will produce a report comprising a prediction of the clinical outcome of a subject diagnosed with colorectal cancer following surgical resection of said cancer. The methods and reports of this invention can further include storing the report in a database. Alternatively, the method can further create a record in a database for the subject and populate the record with data. In one embodiment the report is a paper report, in another embodiment the report is an auditory report, in another embodiment the report is an electronic record. It is contemplated that the report is provided to a physician and/of the patient. The receiving of the report can further include establishing a network connection to a server computer that includes the data and report and requesting the data and report from the server computer.

The methods provided by the present invention may also be automated in whole or in part.

All aspects of the present invention may also be practiced such that a limited number of additional genes that are co-expressed with the disclosed genes, for example as evidenced by high Pearson correlation coefficients, are included in a prognostic or predictive test in addition to and/or in place of disclosed genes.

Having described the invention, the same will be more readily understood through reference to the following Example, which is provided by way of illustration, and is not intended to limit the invention in any way.

EXAMPLES

A Study to Explore Relationships Between Genomic Tumor Expression Profiles and the Likelihood of Recurrence in Dukes' B and Duke's C Patients Treated with Resection of the Colon The primary objective of this study was to determine whether there is a significant relationship between the expression of each of 757 amplicons identified in Table B and clinical outcome in stage II and stage III colon cancer patients who receive colon resection (surgery) without chemotherapy.

Study Design

This was an exploratory study using tissue and outcome data from National Surgical Adjuvant Breast and Bowel Project (NSABP) Studies C-01 and C-02 in up to 400 Dukes B (stage II) and Dukes C (stage III) patients who received colon resection (surgery) only or surgery and postoperative Bacillus Calmette-Guerin (BCG).

Inclusion Criteria

Patients enrolled in either NSABP Study C-01: "A Clinical Trial To Evaluate Postoperative Immunotherapy And Postoperative Systemic Chemotherapy In The Management Of Resectable Colon Cancer" or NSABP Study C-02: "A Protocol To Evaluate The Postoperative Portal Vein Infusion Of 5-Flourouracil And Heparin In Adenocarcinoma Of The Colon" Details of C-01 and C-02 can be found on the NSABP Website at the following URL:

http://www.nsabp.pitt.edu/NSABP_Protocols.htm#treatment%20closed

Tissue samples from the surgery only and surgery+postoperative BCG arms of NSABP C01 and from the surgery only arm of NSABP C02 surgery were combined into one sample set.

Exclusion Criteria

Patients enrolled in NSABP Study C-01 or NSABP Study C-02 were excluded from the present study if one or more of the following applied:

No tumor block available from initial diagnosis in the NSABP archive.

Insufficient tumor in block as assessed by examination of hematoxylin and eosin (H&E) slide Insufficient RNA (<700 ng) recovered from tissue sections for RT-PCR analysis.

Of 1943 patients enrolled in NSABP Study C-01 or NSABP Study C-02, 270 patient samples were available after application of exclusion criteria and used in the gene expression study disclosed herein. The overall demographic and clinical characteristics of the 270 included samples were similar to the original NSABP combined cohorts.

Gene Panel

Seven hundred sixty-one genes, including seven reference genes, were chosen for expression analysis. These genes are listed in Table A together with the sequences of primers and probes used in qRT-PCR to determine expression level.

Experimental Materials and Methods

The expression of 750 cancer-related genes and 7 genes designated for use as reference genes was quantitatively assessed for each patient using TaqMan® RT-PCR, which was performed in singlet with RNA input at 1 nanogram per reaction.

Data Analysis Methods

Reference Normalization

For normalization of extraneous effects, cycle threshold ($C_T$) measurements obtained by RT-PCR were normalized relative to the mean expression of a set of six reference genes. The resulting reference-normalized expression measurements typically range from 0 to 15, where a one unit increase generally reflects a 2-fold increase in RNA quantity.

Comparison of Study Cohort to Original NSABP Study Populations

We compared the distribution of clinical and demographic variables for the current study cohort of evaluable tissue blocks versus the original NSABP C-01 and C-02 study populations. There were no clinically meaningful differences in the distributions.

Univariate Analysis

For each of the 757 amplicons under study, we used the Cox proportional hazard model to examine the relationship between gene expression and recurrence free interval (RFI). The likelihood ratio was used as the test of statistical significance. The method of Benjamini and Hochberg (Benjamini, Y. and Hochberg, Y. (1995). Controlling the false discovery rate: a practical and powerful approach to multiple testing. J.R. Statist. Soc. B 57, 289-300.), as well as resampling and permutation based methods (Tusher V G, Tibshirani R, Chu G (2001) Significance analysis of microarrays applied to the ionizing radiation response. Proc Natl Acad Sci USA, 98:5116-5121; Storey J D, Tibshirani R (2001) Estimating false discovery rates under dependence, with applications to DNA microarrays. Stanford: Stanford University, Department of Statistics; Report No.: Technical Report 2001-28; Korn E L, Troendle J, McShane L, Simon R (2001) Controlling the number of false discoveries: Application to high-dimensional genomic data. Technical Report 003. 2001. National Cancer Institute.) were applied to the resulting set of p-values to estimate false discovery rates. All analyses were repeated for each of the alternative endpoints: distant recurrence free interval (DRFI), overall survival (OS), and disease free survival (DFS).

Multivariate Analysis

For each of the 757 amplicons under study, we used the Cox proportional hazard model to examine the relationship between gene expression and RFI, while controlling for the effects of other standard clinical covariates (including tumor location, surgery type, tumor grade, number of lymph nodes examined, and number of positive lymph nodes. The difference in the log likelihoods of the (reduced) model including only the standard clinical covariates and the (full) model including the standard clinical covariates plus gene expression was used as the test of statistical significance.

Non-Linear Analysis

For each of the 757 amplicons under study, we explored alternative functional relationships between gene expression and recurrence using several different methods. For each amplicon, we fit a Cox proportional hazards model of RFI as a function of gene expression using a 2 degree-of-freedom (DF) natural spline (Stone C, Koo C. (1985) In Proceedings of the Statistical Computing Section ASA. Washington, D.C., 45-48). Statistical significance was assessed by the 2 DF likelihood ratio test for the model. Functional relationships were also explored by examining the pattern of (smoothed) Martingale residuals derived from univariate Cox proportional hazards models of RFI as a strictly linear function of gene expression (Gray R J (1992) Flexible methods for analyzing survival data using splines, with applications to breast cancer prognosis. Journal of the American Statistical Association, 87:942-951; Gray R J (1994) Spline-based tests in survival analysis. Biometrics, 50:640-652; Gray R J (1990) Some diagnostic methods for Cox regression models through hazard smoothing. Biometrics, 46:93-102.). Additionally, cumulative sums of Martingale residuals from each the same Cox proportional hazards models were used to detect departures from linearity (Lin D, Wei L, Ying Z. (1993) Checking the Cox Model with Cumulative Sums of Martingale-Based Residuals. Vol. 80, No. 3, 557-572).

Interaction with Stage

We determined whether there is a significantly different relationship between gene expression and RFI in stage II and stage III patients. For each of the 757 amplicons, we tested the hypothesis that there is a significant difference between the (reduced) proportional hazards model for gene expression and tumor stage versus the (full) proportional hazards model based on gene expression, tumor stage, and their interaction. The difference in the log likelihoods of the reduced and full models was used as the test of statistical significance.

Table A shows qRT-PCR probe and primer sequences for all genes included in the study described in the Example.

Table B shows target amplicons for all genes included in the study described in the Example.

First Analysis Study Results

Reference Gene set for the first analysis was CLTC, FZD6, NEDD8, RPLPO, RPS13, UBB, UBC.

Table 1A shows associations for those genes whose increased expression is predictive of shorter Recurrence-Free Interval (RFI) based on univariate proportional hazards analysis.

Table 1B shows associations for those genes whose increased expression is predictive of longer Recurrence-Free Interval (RFI) based on univariate proportional hazards analysis.

Table 2A shows associations for those genes whose increased expression is predictive of decreased rate of Overall Survival (OS) based on univariate proportional hazards analysis.

Table 2B shows associations for those genes whose increased expression is predictive of increased rate of Overall Survival (OS) based on univariate proportional hazards analysis.

Table 3A shows associations for those genes whose increased expression is predictive of decreased rate of Disease Free Survival (DFS) based on univariate proportional hazards analysis.

Table 3B shows associations for those genes whose increased expression is predictive of increased rate of Disease Free Survival (DFS) based on univariate proportional hazards analysis.

Table 4A shows associations for those genes whose increased expression is predictive of shorter Distant Recurrence-Free Interval (DRFI) based on univariate proportional hazards analysis.

Table 4B shows associations for those genes whose increased expression is predictive of longer Distant Recurrence-Free Interval (DRFI) based on univariate proportional hazards analysis.

Table 5A shows associations between gene expression and RFI for those genes whose increased expression is predictive of shorter Recurrence-Free Interval (RFI), based on a multivariate analysis controlling for particular demographic and clinical characteristics of patients included in the analysis.

Table 5B shows associations between gene expression and RFI for those genes whose increased expression is predictive of longer Recurrence-Free Interval (RFI), based on a multivariate analysis controlling for particular demographic and clinical characteristics of patients included in the analysis.

Table 6 shows genes for which an association between gene expression and clinical outcome was identified based on a nonlinear proportional hazards analysis, using a 2 degree-of-freedom natural spline.

Table 7 shows all genes exhibiting an interaction (p-value<0.05) with tumor stage.

Table 1A shows associations between clinical outcome and gene expression for those genes which demonstrated a Hazard Ratio>1.0 and for which p<0.1. Univariate Cox Proportional Hazards Regression analysis was applied in combined Stage II (Duke's B) and Stage III (Duke's C) patients using RFI as the metric for clinical outcome.

TABLE 1A

| Gene | Hazard Ratio | P Value | OfficialSymbol | Accession Number |
| --- | --- | --- | --- | --- |
| RARB | 2.13 | 0.0252 | RARB | NM_016152 |
| ITGB1 | 1.94 | 0.0002 | ITGB1 | NM_002211 |
| ALDOA | 1.92 | 0.0853 | ALDOA | NM_000034 |
| ANXA2 | 1.90 | <.0001 | ANXA2 | NM_004039 |
| CYP3A4 | 1.81 | 0.0038 | CYP3A4 | NM_017460 |

TABLE 1A-continued

| Gene | Hazard Ratio | P Value | OfficialSymbol | Accession Number |
| --- | --- | --- | --- | --- |
| KRAS2 | 1.64 | 0.0043 | KRAS | NM_004985 |
| COX2 | 1.62 | 0.0521 | PTGS2 | NM_000963 |
| RhoC | 1.61 | 0.0034 | RHOC | NM_175744 |
| TJP1 | 1.60 | 0.0554 | TJP1 | NM_003257 |
| RhoB | 1.57 | 0.0001 | RHOB | NM_004040 |
| KIAA0125 | 1.56 | 0.0940 | KIAA0125 | NM_014792 |
| TIMP1 | 1.52 | <.0001 | TIMP1 | NM_003254 |
| UBC | 1.49 | 0.0031 | UBC | NM_021009 |
| ANXA5 | 1.49 | 0.0084 | ANXA5 | NM_001154 |
| NTN1 | 1.49 | 0.0386 | NTN1 | NM_004822 |
| AKT3 | 1.47 | <.0001 | AKT3 | NM_005465 |
| CALD1 | 1.46 | 0.0007 | CALD1 | NM_004342 |
| IGFBP7 | 1.46 | 0.0019 | IGFBP7 | NM_001553 |
| VEGFC | 1.45 | 0.0092 | VEGFC | NM_005429 |
| BGN | 1.44 | 0.0002 | BGN | NM_001711 |
| CYP1B1 | 1.44 | 0.0180 | CYP1B1 | NM_000104 |
| DLC1 | 1.43 | 0.0012 | DLC1 | NM_006094 |
| SI | 1.43 | 0.0063 | SI | NM_001041 |
| CCNE2 variant 1 | 1.43 | 0.0506 | CCNE2 | NM_057749 |
| LAMC2 | 1.42 | 0.0003 | LAMC2 | NM_005562 |
| TIMP2 | 1.42 | 0.0018 | TIMP2 | NM_003255 |
| CDC42BPA | 1.42 | 0.0029 | CDC42BPA | NM_003607 |
| p21 | 1.41 | 0.0062 | CDKN1A | NM_000389 |
| HB-EGF | 1.40 | 0.0105 | HBEGF | NM_001945 |
| TLN1 | 1.40 | 0.0260 | TLN1 | NM_006289 |
| DUSP1 | 1.39 | <.0001 | DUSP1 | NM_004417 |
| ROCK1 | 1.39 | 0.0121 | ROCK1 | NM_005406 |
| CTSB | 1.39 | 0.0307 | CTSB | NM_001908 |
| ITGAV | 1.38 | 0.0020 | ITGAV | NM_002210 |
| HSPG2 | 1.38 | 0.0215 | HSPG2 | NM_005529 |
| GADD45B | 1.37 | 0.0002 | GADD45B | NM_015675 |
| VCL | 1.37 | 0.0201 | VCL | NM_003373 |
| SBA2 | 1.37 | 0.0250 | WSB2 | NM_018639 |
| Maspin | 1.36 | <.0001 | SERPINB5 | NM_002639 |
| CGB | 1.36 | 0.0018 | CGB | NM_000737 |
| TIMP3 | 1.36 | 0.0024 | TIMP3 | NM_000362 |
| VIM | 1.36 | 0.0073 | VIM | NM_003380 |
| S100A1 | 1.36 | 0.0247 | S100A1 | NM_006271 |
| INHBA | 1.35 | 0.0008 | INHBA | NM_002192 |
| SIR2 | 1.35 | 0.0039 | SIRT1 | NM_012238 |
| TMSB10 | 1.35 | 0.0469 | TMSB10 | NM_021103 |
| CD68 | 1.34 | 0.0036 | CD68 | NM_001251 |
| RBX1 | 1.34 | 0.0469 | RBX1 | NM_014248 |
| INHBB | 1.34 | 0.0514 | INHBB | NM_002193 |
| PKR2 | 1.34 | 0.0628 | PKM2 | NM_002654 |
| FOS | 1.33 | 0.0006 | FOS | NM_005252 |
| FYN | 1.33 | 0.0036 | FYN | NM_002037 |
| LOXL2 | 1.33 | 0.0064 | LOXL2 | NM_002318 |
| STC1 | 1.33 | 0.0101 | STC1 | NM_003155 |
| DKK1 | 1.33 | 0.0208 | DKK1 | NM_012242 |
| IGFBP5 | 1.32 | 0.0064 | IGFBP5 | NM_000599 |
| EPAS1 | 1.32 | 0.0270 | EPAS1 | NM_001430 |
| UNC5C | 1.32 | 0.0641 | UNC5C | NM_003728 |
| FAP | 1.31 | 0.0017 | FAP | NM_004460 |
| IGFBP3 | 1.31 | 0.0041 | IGFBP3 | NM_000598 |
| SNAI2 | 1.31 | 0.0055 | SNAI2 | NM_003068 |
| PRKCA | 1.31 | 0.0065 | PRKCA | NM_002737 |
| FST | 1.31 | 0.0399 | FST | NM_006350 |
| KCNH2 iso a/b | 1.31 | 0.0950 | KCNH2 | NM_000238 |
| CTHRC1 | 1.30 | 0.0017 | CTHRC1 | NM_138455 |
| PDGFC | 1.30 | 0.0034 | PDGFC | NM_016205 |
| EGR1 | 1.30 | 0.0048 | EGR1 | NM_001964 |
| TAGLN | 1.30 | 0.0058 | TAGLN | NM_003186 |
| SPARC | 1.30 | 0.0104 | SPARC | NM_003118 |
| KLF6 | 1.30 | 0.0514 | KLF6 | NM_001300 |
| GRIK1 | 1.30 | 0.0753 | GRIK1 | NM_000830 |
| CYR61 | 1.29 | 0.0018 | CYR61 | NM_001554 |
| SLPI | 1.29 | 0.0026 | SLPI | NM_003064 |
| COL1A2 | 1.29 | 0.0076 | COL1A2 | NM_000089 |
| MAPK14 | 1.29 | 0.0916 | MAPK14 | NM_139012 |
| LAMA3 | 1.28 | 0.0020 | LAMA3 | NM_000227 |
| THBS1 | 1.28 | 0.0053 | THBS1 | NM_003246 |
| NRP2 | 1.28 | 0.0120 | NRP2 | NM_003872 |
| LOX | 1.27 | 0.0028 | LOX | NM_002317 |
| S100A4 | 1.27 | 0.0067 | S100A4 | NM_002961 |
| CXCR4 | 1.27 | 0.0083 | CXCR4 | NM_003467 |

TABLE 1A-continued

| Gene | Hazard Ratio | P Value | OfficialSymbol | Accession Number |
|---|---|---|---|---|
| CEBPB | 1.27 | 0.0943 | CEBPB | NM_005194 |
| AKAP12 | 1.26 | 0.0044 | AKAP12 | NM_005100 |
| ADAMTS12 | 1.26 | 0.0100 | ADAMTS12 | NM_030955 |
| CRYAB | 1.25 | 0.0038 | CRYAB | NM_001885 |
| Grb10 | 1.25 | 0.0108 | GRB10 | NM_005311 |
| MCP1 | 1.25 | 0.0118 | CCL2 | NM_002982 |
| COL1A1 | 1.25 | 0.0167 | COL1A1 | NM_000088 |
| EFNB2 | 1.25 | 0.0241 | EFNB2 | NM_004093 |
| ANXA1 | 1.25 | 0.0292 | ANXA1 | NM_000700 |
| ANGPT2 | 1.25 | 0.0485 | ANGPT2 | NM_001147 |
| EphB6 | 1.25 | 0.0825 | EPHB6 | NM_004445 |
| HSPA1A | 1.24 | 0.0018 | HSPA1A | NM_005345 |
| TGFB3 | 1.24 | 0.0081 | TGFB3 | NM_003239 |
| PTGER3 | 1.24 | 0.0306 | PTGER3 | NM_000957 |
| FXYD5 | 1.24 | 0.0367 | FXYD5 | NM_014164 |
| CAPG | 1.24 | 0.0604 | CAPG | NM_001747 |
| PDGFB | 1.23 | 0.0157 | PDGFB | NM_002608 |
| ANTXR1 | 1.23 | 0.0164 | ANTXR1 | NM_032208 |
| TGFBI | 1.23 | 0.0191 | TGFBI | NM_000358 |
| CTGF | 1.23 | 0.0233 | CTGF | NM_001901 |
| PDGFA | 1.23 | 0.0274 | | NM_002607 |
| P14ARF | 1.23 | 0.0362 | | S78535 |
| KLK10 | 1.22 | 0.0005 | KLK10 | NM_002776 |
| ITGA5 | 1.22 | 0.0178 | ITGA5 | NM_002205 |
| GBP2 | 1.22 | 0.0201 | GBP2 | NM_004120 |
| SIAT4A | 1.22 | 0.0231 | ST3GAL1 | NM_003033 |
| GJB2 | 1.22 | 0.0271 | GJB2 | NM_004004 |
| LAT | 1.22 | 0.0306 | LAT | NM_014387 |
| CTSL | 1.22 | 0.0331 | CTSL | NM_001912 |
| DAPK1 | 1.22 | 0.0384 | DAPK1 | NM_004938 |
| SKP1A | 1.22 | 0.0542 | SKP1A | NM_006930 |
| NDRG1 | 1.22 | 0.0712 | NDRG1 | NM_006096 |
| ITGB5 | 1.22 | 0.0991 | ITGB5 | NM_002213 |
| KLK6 | 1.21 | 0.0034 | KLK6 | NM_002774 |
| SFRP2 | 1.21 | 0.0037 | SFRP2 | NM_003013 |
| TMEPAI | 1.21 | 0.0173 | TMEPAI | NM_020182 |
| ID4 | 1.21 | 0.0530 | ID4 | NM_001546 |
| SFRP4 | 1.20 | 0.0077 | SFRP4 | NM_003014 |
| HOXB7 | 1.20 | 0.0274 | HOXB7 | NM_004502 |
| GJA1 | 1.20 | 0.0311 | GJA1 | NM_000165 |
| CDH11 | 1.20 | 0.0662 | CDH11 | NM_001797 |
| PAI1 | 1.19 | 0.0060 | SERPINE1 | NM_000602 |
| S100P | 1.19 | 0.0119 | S100P | NM_005980 |
| EGR3 | 1.19 | 0.0164 | EGR3 | NM_004430 |
| EMP1 | 1.19 | 0.0460 | EMP1 | NM_001423 |
| ABCC5 | 1.19 | 0.0536 | ABCC5 | NM_005688 |
| FZD1 | 1.19 | 0.0701 | FZD1 | NM_003505 |
| MAD | 1.19 | 0.0811 | MXD1 | NM_002357 |
| EFNA1 | 1.19 | 0.0920 | EFNA1 | NM_004428 |
| OPN_osteopontin | 1.18 | 0.0028 | SPP1 | NM_000582 |
| ALDH1A1 | 1.18 | 0.0246 | ALDH1A1 | NM_000689 |
| NR4A1 | 1.18 | 0.0277 | NR4A1 | NM_002135 |
| SIAT7B | 1.18 | 0.0301 | ST6GALNAC2 | NM_006456 |
| p16-INK4 | 1.18 | 0.0439 | | L27211 |
| TUBB | 1.18 | 0.0761 | TUBB2 | NM_001069 |
| IL6 | 1.18 | 0.0939 | IL6 | NM_000600 |
| RAB32 | 1.18 | 0.0948 | RAB32 | NM_006834 |
| TULP3 | 1.18 | 0.0953 | TULP3 | NM_003324 |
| F3 | 1.17 | 0.0561 | F3 | NM_001993 |
| PLK3 | 1.16 | 0.0792 | PLK3 | NM_004073 |
| EPHA2 | 1.16 | 0.0962 | EPHA2 | NM_004431 |
| SLC2A1 | 1.15 | 0.0745 | SLC2A1 | NM_006516 |
| CXCL12 | 1.14 | 0.0911 | CXCL12 | NM_000609 |
| S100A2 | 1.13 | 0.0287 | S100A2 | NM_005978 |
| FABP4 | 1.13 | 0.0340 | FABP4 | NM_001442 |
| STMY3 | 1.13 | 0.0517 | MMP11 | NM_005940 |
| BCAS1 | 1.13 | 0.0939 | BCAS1 | NM_003657 |
| REG4 | 1.11 | 0.0026 | REG4 | NM_032044 |
| pS2 | 1.09 | 0.0605 | TFF1 | NM_003225 |
| MUC2 | 1.06 | 0.0626 | MUC2 | NM_002457 |

Table 1B shows associations between clinical outcome and gene expression for those genes which demonstrated a Hazard Ratio<1.0 and for which p<0.1. Univariate Cox Proportional Hazards Regression analysis was applied in combined Stage II (Duke's B) and Stage III (Duke's C) patients using RFI as the metric for clinical outcome.

TABLE 1B

| Gene | Hazard Ratio | P Value | OfficialSymbol | Accession Number |
|---|---|---|---|---|
| ORC1L | 0.42 | 0.0728 | ORC1L | NM_004153 |
| HSPA8 | 0.62 | 0.0430 | HSPA8 | NM_006597 |
| E2F1 | 0.64 | 0.0009 | E2F1 | NM_005225 |
| RAD54L | 0.65 | 0.0026 | RAD54L | NM_003579 |
| RPLPO | 0.67 | 0.0150 | RPLP0 | NM_001002 |
| BRCA1 | 0.68 | 0.0001 | BRCA1 | NM_007295 |
| DHFR | 0.69 | 0.0096 | DHFR | NM_000791 |
| SLC25A3 | 0.69 | 0.0110 | SLC25A3 | NM_213611 |
| PPM1D | 0.71 | 0.0033 | PPM1D | NM_003620 |
| SKP2 | 0.71 | 0.0098 | SKP2 | NM_005983 |
| FASN | 0.72 | 0.0071 | FASN | NM_004104 |
| HNRPD | 0.72 | 0.0686 | HNRPD | NM_031370 |
| ENO1 | 0.73 | 0.0418 | ENO1 | NM_001428 |
| RPS13 | 0.75 | 0.0786 | RPS13 | NM_001017 |
| DDB1 | 0.75 | 0.0804 | DDB1 | NM_001923 |
| C20 orf1 | 0.76 | 0.0122 | TPX2 | NM_012112 |
| KIF22 | 0.76 | 0.0137 | KIF22 | NM_007317 |
| Chk1 | 0.76 | 0.0174 | CHEK1 | NM_001274 |
| TCF-1 | 0.77 | 0.0021 | TCF1 | NM_000545 |
| ST14 | 0.77 | 0.0446 | ST14 | NM_021978 |
| RRM1 | 0.77 | 0.0740 | RRM1 | NM_001033 |
| BRCA2 | 0.77 | 0.0800 | BRCA2 | NM_000059 |
| LMNB1 | 0.78 | 0.0513 | LMNB1 | NM_005573 |
| CMYC | 0.79 | 0.0086 | MYC | NM_002467 |
| CDC20 | 0.79 | 0.0290 | CDC20 | NM_001255 |
| CSEL1 | 0.79 | 0.0344 | CSE1L | NM_001316 |
| Bax | 0.79 | 0.0662 | BAX | NM_004324 |
| NME1 | 0.79 | 0.0742 | NME1 | NM_000269 |
| c-myb (MYB official) | 0.80 | 0.0077 | MYB | NM_005375 |
| CDCA7 v2 | 0.80 | 0.0159 | CDCA7 | NM_145810 |
| EFP | 0.80 | 0.0405 | TRIM25 | NM_005082 |
| UBE2M | 0.80 | 0.0437 | UBE2M | NM_003969 |
| RRM2 | 0.81 | 0.0168 | RRM2 | NM_001034 |
| ABCC6 | 0.81 | 0.0373 | ABCC6 | NM_001171 |
| SURV | 0.81 | 0.0584 | BIRC5 | NM_001168 |
| CKS2 | 0.81 | 0.0753 | CKS2 | NM_001827 |
| RAF1 | 0.81 | 0.0899 | RAF1 | NM_002880 |
| EPHB2 | 0.82 | 0.0190 | EPHB2 | NM_004442 |
| NOTCH1 | 0.82 | 0.0232 | NOTCH1 | NM_017617 |
| UMPS | 0.82 | 0.0456 | UMPS | NM_000373 |
| CCNE2 | 0.82 | 0.0544 | CCNE2 | NM_057749 |
| PI3KC2A | 0.82 | 0.0916 | PIK3C2A | NM_002645 |
| CD80 | 0.82 | 0.0954 | CD80 | NM_005191 |
| AREG | 0.83 | 0.0014 | AREG | NM_001657 |
| EREG | 0.83 | 0.0062 | EREG | NM_001432 |
| MYBL2 | 0.83 | 0.0259 | MYBL2 | NM_002466 |
| ABCB1 | 0.83 | 0.0322 | ABCB1 | NM_000927 |
| HRAS | 0.83 | 0.0760 | HRAS | NM_005343 |
| SLC7A5 | 0.84 | 0.0585 | SLC7A5 | NM_003486 |
| MAD2L1 | 0.84 | 0.0590 | MAD2L1 | NM_002358 |
| Ki-67 | 0.85 | 0.0620 | MKI67 | NM_002417 |
| MCM2 | 0.85 | 0.0700 | MCM2 | NM_004526 |
| ING5 | 0.85 | 0.0947 | ING5 | NM_032329 |
| Cdx2 | 0.88 | 0.0476 | CDX2 | NM_001265 |
| PTPRO | 0.89 | 0.0642 | PTPRO | NM_030667 |
| cripto (TDGF1 official) | 0.90 | 0.0803 | TDGF1 | NM_003212 |

Table 2A shows associations between clinical outcome and gene expression for those genes which demonstrated a Hazard Ratio>1.0 and for which p<0.1. Univariate Cox Proportional Hazards Regression analysis was applied in combined Stage II (Duke's B) and Stage III (Duke's C) patients using OS as the metric for clinical outcome.

TABLE 2A

| Gene | Hazard Ratio | P Value | OfficialSymbol | Accession Number |
|---|---|---|---|---|
| RARB | 1.75 | 0.0820 | RARB | NM_016152 |
| RhoC | 1.70 | 0.0001 | RHOC | NM_175744 |
| ANXA2 | 1.64 | 0.0002 | ANXA2 | NM_004039 |
| CYP3A4 | 1.58 | 0.0064 | CYP3A4 | NM_017460 |
| p21 | 1.54 | <.0001 | CDKN1A | NM_000389 |
| ITGB1 | 1.54 | 0.0058 | ITGB1 | NM_002211 |
| UBC | 1.50 | 0.0003 | UBC | NM_021009 |
| TNF | 1.46 | 0.0859 | TNF | NM_000594 |
| VEGFC | 1.44 | 0.0049 | VEGFC | NM_005429 |
| HMLH | 1.44 | 0.0435 | MLH1 | NM_000249 |
| RhoB | 1.37 | 0.0015 | RHOB | NM_004040 |
| TGFBR1 | 1.37 | 0.0127 | TGFBR1 | NM_004612 |
| SPINT2 | 1.37 | 0.0235 | SPINT2 | NM_021102 |
| PFN1 | 1.37 | 0.0842 | PFN1 | NM_005022 |
| HSPG2 | 1.36 | 0.0115 | HSPG2 | NM_005529 |
| TIMP1 | 1.35 | 0.0008 | TIMP1 | NM_003254 |
| INHBB | 1.35 | 0.0190 | INHBB | NM_002193 |
| VCL | 1.34 | 0.0099 | VCL | NM_003373 |
| KCNH2 iso a/b | 1.33 | 0.0362 | KCNH2 | NM_000238 |
| LAMC2 | 1.32 | 0.0005 | LAMC2 | NM_005562 |
| FXYD5 | 1.31 | 0.0021 | FXYD5 | NM_014164 |
| HLA-G | 1.31 | 0.0458 | HLA-G | NM_002127 |
| GADD45B | 1.30 | 0.0002 | GADD45B | NM_015675 |
| CDC42 | 1.30 | 0.0120 | CDC42 | NM_001791 |
| LAMB3 | 1.30 | 0.0163 | LAMB3 | NM_000228 |
| DKK1 | 1.30 | 0.0209 | DKK1 | NM_012242 |
| UNC5C | 1.30 | 0.0452 | UNC5C | NM_003728 |
| UBL1 | 1.29 | 0.0171 | SUMO1 | NM_003352 |
| HB-EGF | 1.29 | 0.0262 | HBEGF | NM_001945 |
| KRAS2 | 1.29 | 0.0726 | KRAS | NM_004985 |
| ID3 | 1.28 | 0.0023 | ID3 | NM_002167 |
| LOXL2 | 1.28 | 0.0039 | LOXL2 | NM_002318 |
| EphB6 | 1.28 | 0.0322 | EPHB6 | NM_004445 |
| DUSP1 | 1.27 | 0.0003 | DUSP1 | NM_004417 |
| BGN | 1.27 | 0.0040 | BGN | NM_001711 |
| CALD1 | 1.27 | 0.0119 | CALD1 | NM_004342 |
| CDC42BPA | 1.27 | 0.0151 | CDC42BPA | NM_003607 |
| SBA2 | 1.27 | 0.0373 | WSB2 | NM_018639 |
| INHBA | 1.26 | 0.0018 | INHBA | NM_002192 |
| NRP1 | 1.26 | 0.0113 | NRP1 | NM_003873 |
| TIMP2 | 1.26 | 0.0123 | TIMP2 | NM_003255 |
| KLF6 | 1.26 | 0.0444 | KLF6 | NM_001300 |
| KLK10 | 1.25 | <.0001 | KLK10 | NM_002776 |
| TIMP3 | 1.25 | 0.0083 | TIMP3 | NM_000362 |
| CAPG | 1.25 | 0.0170 | CAPG | NM_001747 |
| IGFBP7 | 1.25 | 0.0249 | IGFBP7 | NM_001553 |
| S100A1 | 1.25 | 0.0529 | S100A1 | NM_006271 |
| SHC1 | 1.25 | 0.0605 | SHC1 | NM_003029 |
| CTSB | 1.25 | 0.0766 | CTSB | NM_001908 |
| ANXA5 | 1.25 | 0.0787 | ANXA5 | NM_001154 |
| PKR2 | 1.25 | 0.0800 | PKM2 | NM_002654 |
| HSPA1A | 1.24 | 0.0003 | HSPA1A | NM_005345 |
| CGB | 1.24 | 0.0148 | CGB | NM_000737 |
| DLC1 | 1.24 | 0.0231 | DLC1 | NM_006094 |
| TMSB10 | 1.24 | 0.0890 | TMSB10 | NM_021103 |
| LAMA3 | 1.23 | 0.0017 | LAMA3 | NM_000227 |
| FOS | 1.23 | 0.0028 | FOS | NM_005252 |
| SNAI2 | 1.23 | 0.0123 | SNAI2 | NM_003068 |
| SPARC | 1.23 | 0.0134 | SPARC | NM_003118 |
| SIR2 | 1.23 | 0.0173 | SIRT1 | NM_012238 |
| KRT19 | 1.23 | 0.0217 | KRT19 | NM_002276 |
| CTSD | 1.23 | 0.0395 | CTSD | NM_001909 |
| EPAS1 | 1.23 | 0.0409 | EPAS1 | NM_001430 |
| GAGE4 | 1.23 | 0.0468 | GAGE4 | NM_001474 |
| BMP4 | 1.22 | 0.0024 | BMP4 | NM_001202 |
| PLK3 | 1.22 | 0.0056 | PLK3 | NM_004073 |
| Grb10 | 1.22 | 0.0059 | GRB10 | NM_005311 |
| FYN | 1.22 | 0.0120 | FYN | NM_002037 |
| STC1 | 1.22 | 0.0409 | STC1 | NM_003155 |
| G-Catenin | 1.22 | 0.0661 | JUP | NM_002230 |
| HK1 | 1.22 | 0.0872 | HK1 | NM_000188 |
| MADH4 | 1.22 | 0.0956 | SMAD4 | NM_005359 |
| KLK6 | 1.21 | 0.0011 | KLK6 | NM_002774 |
| CTHRC1 | 1.21 | 0.0065 | CTHRC1 | NM_138455 |
| LAT | 1.21 | 0.0146 | LAT | NM_014387 |
| IGFBP3 | 1.21 | 0.0149 | IGFBP3 | NM_000598 |
| AKT3 | 1.21 | 0.0212 | AKT3 | NM_005465 |
| HSPA1B | 1.21 | 0.0262 | HSPA1B | NM_005346 |
| THY1 | 1.21 | 0.0278 | THY1 | NM_006288 |
| ANXA1 | 1.21 | 0.0322 | ANXA1 | NM_000700 |
| LOX | 1.20 | 0.0067 | LOX | NM_002317 |
| CD68 | 1.20 | 0.0223 | CD68 | NM_001251 |
| EFNB2 | 1.20 | 0.0268 | EFNB2 | NM_004093 |
| DYRK1B | 1.20 | 0.0473 | DYRK1B | NM_004714 |
| PTK2 | 1.20 | 0.0889 | PTK2 | NM_005607 |
| THBS1 | 1.19 | 0.0203 | THBS1 | NM_003246 |
| TAGLN | 1.19 | 0.0263 | TAGLN | NM_003186 |
| TULP3 | 1.19 | 0.0334 | TULP3 | NM_003324 |
| SR-A1 | 1.19 | 0.0387 | SR-A1 | NM_021228 |
| APC | 1.19 | 0.0433 | APC | NM_000038 |
| ERK1 | 1.19 | 0.0488 | | Z11696 |
| VIM | 1.19 | 0.0661 | VIM | NM_003380 |
| CREBBP | 1.19 | 0.0802 | CREBBP | NM_004380 |
| ANGPT2 | 1.19 | 0.0860 | ANGPT2 | NM_001147 |
| Maspin | 1.18 | 0.0029 | SERPINB5 | NM_002639 |
| PDGFB | 1.18 | 0.0252 | PDGFB | NM_002608 |
| S100A4 | 1.18 | 0.0270 | S100A4 | NM_002961 |
| EGR1 | 1.18 | 0.0334 | EGR1 | NM_001964 |
| IGFBP5 | 1.18 | 0.0526 | IGFBP5 | NM_000599 |
| NOTCH2 | 1.18 | 0.0527 | NOTCH2 | NM_024408 |
| PAI1 | 1.17 | 0.0036 | SERPINE1 | NM_000602 |
| NR4A1 | 1.17 | 0.0110 | NR4A1 | NM_002135 |
| BCAS1 | 1.17 | 0.0137 | BCAS1 | NM_003657 |
| BRK | 1.17 | 0.0137 | PTK6 | NM_005975 |
| AKAP12 | 1.17 | 0.0195 | AKAP12 | NM_005100 |
| EMP1 | 1.17 | 0.0291 | EMP1 | NM_001423 |
| SIAT4A | 1.17 | 0.0304 | ST3GAL1 | NM_003033 |
| MRP3 | 1.17 | 0.0334 | ABCC3 | NM_003786 |
| COL1A1 | 1.17 | 0.0399 | COL1A1 | NM_000088 |
| Upa | 1.17 | 0.0588 | PLAU | NM_002658 |
| UNC5B | 1.17 | 0.0986 | UNC5B | NM_170744 |
| PDGFC | 1.16 | 0.0355 | PDGFC | NM_016205 |
| MCP1 | 1.16 | 0.0449 | CCL2 | NM_002982 |
| CTGF | 1.16 | 0.0576 | CTGF | NM_001901 |
| COL1A2 | 1.16 | 0.0612 | COL1A2 | NM_000089 |
| RAB32 | 1.16 | 0.0645 | RAB32 | NM_006834 |
| SIN3A | 1.16 | 0.0787 | SIN3A | NM_015477 |
| SKP1A | 1.16 | 0.0837 | SKP1A | NM_006930 |
| EFNA1 | 1.16 | 0.0957 | EFNA1 | NM_004428 |
| S100A2 | 1.15 | 0.0040 | S100A2 | NM_005978 |
| MMP7 | 1.15 | 0.0374 | MMP7 | NM_002423 |
| HOXB7 | 1.15 | 0.0405 | HOXB7 | NM_004502 |
| FAP | 1.15 | 0.0455 | FAP | NM_004460 |
| ANTXR1 | 1.15 | 0.0482 | ANTXR1 | NM_032208 |
| TGFBI | 1.15 | 0.0553 | TGFBI | NM_000358 |
| TMEPAI | 1.14 | 0.0435 | TMEPAI | NM_020182 |
| CYR61 | 1.14 | 0.0490 | CYR61 | NM_001554 |
| SLPI | 1.14 | 0.0724 | SLPI | NM_003064 |
| TP53I3 | 1.14 | 0.0831 | TP53I3 | NM_004881 |
| PDGFA | 1.14 | 0.0845 | | NM_002607 |
| SFRP2 | 1.13 | 0.0255 | SFRP2 | NM_003013 |
| S100A8 | 1.13 | 0.0693 | S100A8 | NM_002964 |
| F3 | 1.13 | 0.0708 | F3 | NM_001993 |
| Bcl2 | 1.13 | 0.0962 | BCL2 | NM_000633 |
| OPN_osteopontin | 1.12 | 0.0097 | SPP1 | NM_000582 |
| FZD6 | 1.12 | 0.0692 | FZD6 | NM_003506 |
| OSM | 1.11 | 0.0744 | OSM | NM_020530 |
| EGLN3 | 1.11 | 0.0884 | EGLN3 | NM_022073 |
| SIAT7B | 1.11 | 0.0938 | ST6GALNAC2 | NM_006456 |
| FABP4 | 1.10 | 0.0454 | FABP4 | NM_001442 |
| EFNA3 | 1.10 | 0.0958 | EFNA3 | NM_004952 |
| MMP2 | 1.10 | 0.0969 | MMP2 | NM_004530 |
| GSTT1 | 1.09 | 0.0737 | GSTT1 | NM_000853 |
| REG4 | 1.07 | 0.0286 | REG4 | NM_032044 |

Table 2B shows associations between clinical outcome and gene expression for those genes which demonstrated a Hazard Ratio<1.0 and for which p<0.1. Univariate Cox Proportional Hazards Regression analysis was applied in combined Stage II (Duke's B) and Stage III (Duke's C) patients using OS as the metric for clinical outcome.

TABLE 2B

| Gene | Hazard Ratio | P Value | Official Symbol | Accession Number |
|---|---|---|---|---|
| HSPA8 | 0.62 | 0.0145 | HSPA8 | NM_006597 |
| SKP2 | 0.70 | 0.0010 | SKP2 | NM_005983 |
| DHFR | 0.74 | 0.0085 | DHFR | NM_000791 |
| PRDX4 | 0.74 | 0.0197 | PRDX4 | NM_006406 |
| RRM1 | 0.75 | 0.0162 | RRM1 | NM_001033 |
| SLC25A3 | 0.75 | 0.0342 | SLC25A3 | NM_213611 |
| RPLPO | 0.75 | 0.0416 | RPLP0 | NM_001002 |
| E2F1 | 0.78 | 0.0190 | E2F1 | NM_005225 |
| SURV | 0.79 | 0.0086 | BIRC5 | NM_001168 |
| c-myb (MYB official) | 0.80 | 0.0020 | MYB | NM_005375 |
| BRCA1 | 0.80 | 0.0077 | BRCA1 | NM_007295 |
| Chk1 | 0.80 | 0.0186 | CHEK1 | NM_001274 |
| ST14 | 0.80 | 0.0407 | ST14 | NM_021978 |
| TCF-1 | 0.81 | 0.0045 | TCF1 | NM_000545 |
| CCNE2 | 0.81 | 0.0112 | CCNE2 | NM_057749 |
| PPM1D | 0.81 | 0.0194 | PPM1D | NM_003620 |
| CDC20 | 0.81 | 0.0213 | CDC20 | NM_001255 |
| EI24 | 0.81 | 0.0585 | EI24 | NM_004879 |
| C20orf1 | 0.82 | 0.0348 | TPX2 | NM_012112 |
| DUT | 0.83 | 0.0396 | DUT | NM_001948 |
| CD44E | 0.83 | 0.0439 | | X55150 |
| KIF22 | 0.83 | 0.0506 | KIF22 | NM_007317 |
| PPID | 0.83 | 0.0615 | PPID | NM_005038 |
| UBE2M | 0.83 | 0.0805 | UBE2M | NM_003969 |
| LMNB1 | 0.83 | 0.0868 | LMNB1 | NM_005573 |
| MCM2 | 0.84 | 0.0207 | MCM2 | NM_004526 |
| CDC6 | 0.84 | 0.0218 | CDC6 | NM_001254 |
| MRPL40 | 0.84 | 0.0769 | MRPL40 | NM_003776 |
| EPHB2 | 0.85 | 0.0253 | EPHB2 | NM_004442 |
| CMYC | 0.85 | 0.0371 | MYC | NM_002467 |
| AURKB | 0.85 | 0.0375 | AURKB | NM_004217 |
| CDCA7 v2 | 0.85 | 0.0421 | CDCA7 | NM_145810 |
| ABCB1 | 0.86 | 0.0390 | ABCB1 | NM_000927 |
| SMARCA3 | 0.86 | 0.0601 | SMARCA3 | NM_003071 |
| Cdx2 | 0.88 | 0.0166 | CDX2 | NM_001265 |
| PPARG | 0.88 | 0.0645 | PPARG | NM_005037 |
| MYBL2 | 0.88 | 0.0647 | MYBL2 | NM_002466 |
| EREG | 0.89 | 0.0411 | EREG | NM_001432 |
| AREG | 0.90 | 0.0235 | AREG | NM_001657 |

Table 3A shows associations between clinical outcome and gene expression for those genes which demonstrated a Hazard Ratio>1.0 and for which p<0.1. Univariate Cox Proportional Hazards Regression analysis was applied in combined Stage II (Duke's B) and Stage III (Duke's C) patients using DFS as the metric for clinical outcome.

TABLE 3A

| Gene | Hazard Ratio | P Value | Official Symbol | Accession Number |
|---|---|---|---|---|
| ANXA2 | 1.74 | <.0001 | ANXA2 | NM_004039 |
| CYP3A4 | 1.69 | 0.0020 | CYP3A4 | NM_017460 |
| RhoC | 1.53 | 0.0009 | RHOC | NM_175744 |
| TJP1 | 1.45 | 0.0787 | TJP1 | NM_003257 |
| UBC | 1.43 | 0.0007 | UBC | NM_021009 |
| p21 | 1.42 | 0.0004 | CDKN1A | NM_000389 |
| HB-EGF | 1.39 | 0.0032 | HBEGF | NM_001945 |
| SPINT2 | 1.37 | 0.0154 | SPINT2 | NM_021102 |
| HMLH | 1.36 | 0.0711 | MLH1 | NM_000249 |
| VEGFC | 1.35 | 0.0157 | VEGFC | NM_005429 |
| PKR2 | 1.34 | 0.0187 | PKM2 | NM_002654 |
| LAMC2 | 1.33 | 0.0002 | LAMC2 | NM_005562 |
| ITGB1 | 1.33 | 0.0499 | ITGB1 | NM_002211 |
| TIMP1 | 1.32 | 0.0007 | TIMP1 | NM_003254 |
| VCL | 1.31 | 0.0114 | VCL | NM_003373 |
| INHBB | 1.31 | 0.0302 | INHBB | NM_002193 |
| GADD45B | 1.30 | <.0001 | GADD45B | NM_015675 |
| RhoB | 1.30 | 0.0053 | RHOB | NM_004040 |
| DUSP1 | 1.28 | <.0001 | DUSP1 | NM_004417 |
| HK1 | 1.28 | 0.0297 | HK1 | NM_000188 |

TABLE 3A-continued

| Gene | Hazard Ratio | P Value | OfficialSymbol | Accession Number |
|---|---|---|---|---|
| GRIK1 | 1.28 | 0.0364 | GRIK1 | NM_000830 |
| FOS | 1.27 | 0.0002 | FOS | NM_005252 |
| CGB | 1.27 | 0.0126 | CGB | NM_000737 |
| KLF6 | 1.27 | 0.0288 | KLF6 | NM_001300 |
| ANXA5 | 1.27 | 0.0504 | ANXA5 | NM_001154 |
| KRAS2 | 1.27 | 0.0724 | KRAS | NM_004985 |
| INHBA | 1.26 | 0.0009 | INHBA | NM_002192 |
| DLC1 | 1.26 | 0.0096 | DLC1 | NM_006094 |
| IGFBP7 | 1.26 | 0.0116 | IGFBP7 | NM_001553 |
| BGN | 1.25 | 0.0039 | BGN | NM_001711 |
| LOXL2 | 1.25 | 0.0076 | LOXL2 | NM_002318 |
| STC1 | 1.25 | 0.0135 | STC1 | NM_003155 |
| CTSD | 1.25 | 0.0208 | CTSD | NM_001909 |
| HSPG2 | 1.25 | 0.0485 | HSPG2 | NM_005529 |
| KCNH2 iso a/b | 1.25 | 0.0832 | KCNH2 | NM_000238 |
| TIMP3 | 1.24 | 0.0057 | TIMP3 | NM_000362 |
| FXYD5 | 1.24 | 0.0070 | FXYD5 | NM_014164 |
| A-Catenin | 1.24 | 0.0447 | CTNNA1 | NM_001903 |
| LOX | 1.23 | 0.0013 | LOX | NM_002317 |
| EGR1 | 1.23 | 0.0037 | EGR1 | NM_001964 |
| CAPG | 1.23 | 0.0191 | CAPG | NM_001747 |
| LAMB3 | 1.23 | 0.0377 | LAMB3 | NM_000228 |
| GAGE4 | 1.23 | 0.0402 | GAGE4 | NM_001474 |
| SHC1 | 1.23 | 0.0640 | SHC1 | NM_003029 |
| MVP | 1.23 | 0.0726 | MVP | NM_017458 |
| VEGF | 1.22 | 0.0250 | VEGF | NM_003376 |
| UNC5B | 1.22 | 0.0256 | UNC5B | NM_170744 |
| CDC42BPA | 1.22 | 0.0297 | CDC42BPA | NM_003607 |
| SBA2 | 1.22 | 0.0614 | WSB2 | NM_018639 |
| DKK1 | 1.22 | 0.0689 | DKK1 | NM_012242 |
| EphB6 | 1.22 | 0.0763 | EPHB6 | NM_004445 |
| IGFBP3 | 1.21 | 0.0078 | IGFBP3 | NM_000598 |
| HSPA1B | 1.21 | 0.0167 | HSPA1B | NM_005346 |
| CALD1 | 1.21 | 0.0277 | CALD1 | NM_004342 |
| TIMP2 | 1.21 | 0.0309 | TIMP2 | NM_003255 |
| NR4A1 | 1.20 | 0.0023 | NR4A1 | NM_002135 |
| LAMA3 | 1.20 | 0.0028 | LAMA3 | NM_000227 |
| SIAT4A | 1.20 | 0.0082 | ST3GAL1 | NM_003033 |
| PDGFB | 1.20 | 0.0084 | PDGFB | NM_002608 |
| EMP1 | 1.20 | 0.0107 | EMP1 | NM_001423 |
| THBS1 | 1.20 | 0.0126 | THBS1 | NM_003246 |
| CD68 | 1.20 | 0.0143 | CD68 | NM_001251 |
| FYN | 1.20 | 0.0151 | FYN | NM_002037 |
| TULP3 | 1.20 | 0.0213 | TULP3 | NM_003324 |
| EFNA1 | 1.20 | 0.0254 | EFNA1 | NM_004428 |
| SIR2 | 1.20 | 0.0255 | SIRT1 | NM_012238 |
| G-Catenin | 1.20 | 0.0689 | JUP | NM_002230 |
| S100A1 | 1.20 | 0.0998 | S100A1 | NM_006271 |
| Maspin | 1.19 | 0.0013 | SERPINB5 | NM_002639 |
| HSPA1A | 1.19 | 0.0013 | HSPA1A | NM_005345 |
| SPARC | 1.19 | 0.0359 | SPARC | NM_003118 |
| PTHR1 | 1.19 | 0.0801 | PTHR1 | NM_000316 |
| SNAI2 | 1.18 | 0.0353 | SNAI2 | NM_003068 |
| KRT19 | 1.18 | 0.0419 | KRT19 | NM_002276 |
| ERK1 | 1.18 | 0.0459 | | Z11696 |
| KLK10 | 1.17 | 0.0007 | KLK10 | NM_002776 |
| BMP4 | 1.17 | 0.0121 | BMP4 | NM_001202 |
| CYR61 | 1.17 | 0.0127 | CYR61 | NM_001554 |
| Grb10 | 1.17 | 0.0216 | GRB10 | NM_005311 |
| PLK3 | 1.17 | 0.0242 | PLK3 | NM_004073 |
| EFNB2 | 1.17 | 0.0403 | EFNB2 | NM_004093 |
| P14ARF | 1.17 | 0.0439 | | S78535 |
| ID3 | 1.17 | 0.0446 | ID3 | NM_002167 |
| IGFBP5 | 1.17 | 0.0503 | IGFBP5 | NM_000599 |
| THY1 | 1.17 | 0.0574 | THY1 | NM_006288 |
| VIM | 1.17 | 0.0858 | VIM | NM_003380 |
| EPAS1 | 1.17 | 0.0897 | EPAS1 | NM_001430 |
| PAI1 | 1.16 | 0.0039 | SERPINE1 | NM_000602 |
| F3 | 1.16 | 0.0172 | F3 | NM_001993 |
| CTHRC1 | 1.16 | 0.0181 | CTHRC1 | NM_138455 |
| ANTXR1 | 1.16 | 0.0237 | ANTXR1 | NM_032208 |
| FAP | 1.16 | 0.0289 | FAP | NM_004460 |
| ADAMTS12 | 1.16 | 0.0350 | ADAMTS12 | NM_030955 |
| CTGF | 1.16 | 0.0424 | CTGF | NM_001901 |
| PTGER3 | 1.16 | 0.0569 | PTGER3 | NM_000957 |
| ANXA1 | 1.16 | 0.0699 | ANXA1 | NM_000700 |

TABLE 3A-continued

| Gene | Hazard Ratio | P Value | Official Symbol | Accession Number |
|---|---|---|---|---|
| NRP1 | 1.16 | 0.0797 | NRP1 | NM_003873 |
| NDRG1 | 1.16 | 0.0856 | NDRG1 | NM_006096 |
| KLK6 | 1.15 | 0.0092 | KLK6 | NM_002774 |
| EGR3 | 1.15 | 0.0153 | EGR3 | NM_004430 |
| HOXB7 | 1.15 | 0.0345 | HOXB7 | NM_004502 |
| PDGFC | 1.15 | 0.0363 | PDGFC | NM_016205 |
| Herstatin | 1.15 | 0.0403 | | AF177761 |
| MCP1 | 1.15 | 0.0409 | CCL2 | NM_002982 |
| TGFBI | 1.15 | 0.0437 | TGFBI | NM_000358 |
| TP53I3 | 1.15 | 0.0438 | TP53I3 | NM_004881 |
| SLPI | 1.15 | 0.0457 | SLPI | NM_003064 |
| PLAUR | 1.15 | 0.0471 | PLAUR | NM_002659 |
| GJB2 | 1.15 | 0.0610 | GJB2 | NM_004004 |
| COL1A1 | 1.15 | 0.0647 | COL1A1 | NM_000088 |
| IL6 | 1.15 | 0.0790 | IL6 | NM_000600 |
| APC | 1.15 | 0.0821 | APC | NM_000038 |
| S100A2 | 1.14 | 0.0048 | S100A2 | NM_005978 |
| TMEPAI | 1.14 | 0.0300 | TMEPAI | NM_020182 |
| PDGFA | 1.14 | 0.0644 | | NM_002607 |
| S100A4 | 1.14 | 0.0680 | S100A4 | NM_002961 |
| TAGLN | 1.14 | 0.0820 | TAGLN | NM_003186 |
| Upa | 1.14 | 0.0823 | PLAU | NM_002658 |
| COL1A2 | 1.14 | 0.0856 | COL1A2 | NM_000089 |
| OSM | 1.13 | 0.0299 | OSM | NM_020530 |
| BRK | 1.13 | 0.0479 | PTK6 | NM_005975 |
| SEMA3B | 1.13 | 0.0525 | SEMA3B | NM_004636 |
| OPN_osteopontin | 1.12 | 0.0084 | SPP1 | NM_000582 |
| S100P | 1.12 | 0.0283 | S100P | NM_005980 |
| SFRP2 | 1.12 | 0.0291 | SFRP2 | NM_003013 |
| EGLN3 | 1.12 | 0.0465 | EGLN3 | NM_022073 |
| SIAT7B | 1.12 | 0.0570 | ST6GALNAC2 | NM_006456 |
| MMP7 | 1.12 | 0.0743 | MMP7 | NM_002423 |
| FABP4 | 1.11 | 0.0195 | FABP4 | NM_001442 |
| AKAP12 | 1.11 | 0.0899 | AKAP12 | NM_005100 |
| EFNA3 | 1.10 | 0.0684 | EFNA3 | NM_004952 |
| SFRP4 | 1.10 | 0.0684 | SFRP4 | NM_003014 |
| CRYAB | 1.10 | 0.0987 | CRYAB | NM_001885 |
| GSTT1 | 1.09 | 0.0457 | GSTT1 | NM_000853 |
| REG4 | 1.08 | 0.0074 | REG4 | NM_032044 |
| pS2 | 1.08 | 0.0302 | TFF1 | NM_003225 |
| MUC5B | 1.08 | 0.0401 | MUC5B | XM_039877 |
| IGFBP2 | 1.08 | 0.0873 | IGFBP2 | NM_000597 |

Table 3B shows associations between clinical outcome and gene expression for those genes which demonstrated a Hazard Ratio<1.0 and for which p<0.1. Univariate Cox Proportional Hazards Regression analysis was applied in combined Stage II (Duke's B) and Stage III (Duke's C) patients using DFS as the metric for clinical outcome.

TABLE 3B

| Gene | Hazard Ratio | P Value | Official Symbol | Accession Number |
|---|---|---|---|---|
| HSPA8 | 0.70 | 0.0487 | HSPA8 | NM_006597 |
| SLC25A3 | 0.71 | 0.0084 | SLC25A3 | NM_213611 |
| E2F1 | 0.73 | 0.0019 | E2F1 | NM_005225 |
| SKP2 | 0.73 | 0.0038 | SKP2 | NM_005983 |
| PPM1D | 0.75 | 0.0008 | PPM1D | NM_003620 |
| RRM1 | 0.76 | 0.0161 | RRM1 | NM_001033 |
| RPLPO | 0.76 | 0.0388 | RPLP0 | NM_001002 |
| NPM1 | 0.78 | 0.0223 | NPM1 | NM_002520 |
| DDB1 | 0.78 | 0.0673 | DDB1 | NM_001923 |
| PRDX4 | 0.79 | 0.0526 | PRDX4 | NM_006406 |
| BRCA1 | 0.80 | 0.0051 | BRCA1 | NM_007295 |
| Chk1 | 0.80 | 0.0114 | CHEK1 | NM_001274 |
| SURV | 0.81 | 0.0155 | BIRC5 | NM_001168 |
| C20 orf1 | 0.81 | 0.0195 | TPX2 | NM_012112 |
| EI24 | 0.81 | 0.0382 | EI24 | NM_004879 |
| RAD54L | 0.81 | 0.0501 | RAD54L | NM_003579 |
| DHFR | 0.81 | 0.0530 | DHFR | NM_000791 |
| c-myb (MYB official) | 0.82 | 0.0029 | MYB | NM_005375 |

TABLE 3B-continued

| Gene | Hazard Ratio | P Value | Official Symbol | Accession Number |
|---|---|---|---|---|
| CCNE2 | 0.82 | 0.0109 | CCNE2 | NM_057749 |
| KIF22 | 0.82 | 0.0235 | KIF22 | NM_007317 |
| HMGB1 | 0.82 | 0.0849 | HMGB1 | NM_002128 |
| LMNB1 | 0.83 | 0.0665 | LMNB1 | NM_005573 |
| CDCA7 v2 | 0.84 | 0.0224 | CDCA7 | NM_145810 |
| CDC20 | 0.84 | 0.0461 | CDC20 | NM_001255 |
| FASN | 0.84 | 0.0797 | FASN | NM_004104 |
| ABCB1 | 0.85 | 0.0157 | ABCB1 | NM_000927 |
| MCM2 | 0.85 | 0.0183 | MCM2 | NM_004526 |
| DUT | 0.85 | 0.0469 | DUT | NM_001948 |
| KIF2C | 0.85 | 0.0786 | KIF2C | NM_006845 |
| MCM6 | 0.85 | 0.0791 | MCM6 | NM_005915 |
| EIF4E | 0.85 | 0.0863 | EIF4E | NM_001968 |
| EPHB2 | 0.86 | 0.0271 | EPHB2 | NM_004442 |
| RCC1 | 0.86 | 0.0444 | RCC1 | NM_001269 |
| EFP | 0.86 | 0.0760 | TRIM25 | NM_005082 |
| AREG | 0.87 | 0.0029 | AREG | NM_001657 |
| CMYC | 0.87 | 0.0483 | MYC | NM_002467 |
| GCLC | 0.87 | 0.0824 | GCLC | NM_001498 |
| TCF-1 | 0.88 | 0.0520 | TCF1 | NM_000545 |
| MYBL2 | 0.88 | 0.0527 | MYBL2 | NM_002466 |
| EREG | 0.89 | 0.0237 | EREG | NM_001432 |
| Cdx2 | 0.90 | 0.0353 | CDX2 | NM_001265 |
| PTPRO | 0.92 | 0.0896 | PTPRO | NM_030667 |
| cripto (TDGF1 official) | 0.92 | 0.0913 | TDGF1 | NM_003212 |
| HLA-DRB1 | 0.93 | 0.0536 | HLA-DRB1 | NM_002124 |

Table 4A shows associations between clinical outcome and gene expression for those genes which demonstrated a Hazard Ratio>1.0 and for which p<0.1. Univariate Cox Proportional Hazards Regression analysis was applied in combined Stage II (Duke's B) and Stage III (Duke's C) patients using DRFI as the metric for clinical outcome.

TABLE 4A

| Gene | Hazard Ratio | P Value | Official Symbol | Accession Number |
|---|---|---|---|---|
| ALDOA | 3.37 | 0.0106 | ALDOA | NM_000034 |
| DCK | 2.74 | 0.0130 | DCK | NM_000788 |
| ITGB1 | 2.50 | <0.0001 | ITGB1 | NM_002211 |
| COX2 | 2.15 | 0.0128 | PTGS2 | NM_000963 |
| TJP1 | 2.12 | 0.0072 | TJP1 | NM_003257 |
| STAT3 | 1.98 | 0.0062 | STAT3 | NM_003150 |
| HMLH | 1.93 | 0.0087 | MLH1 | NM_000249 |
| CYP3A4 | 1.90 | 0.0092 | CYP3A4 | NM_017460 |
| RhoC | 1.89 | 0.0033 | RHOC | NM_175744 |
| ANXA2 | 1.87 | 0.0025 | ANXA2 | NM_004039 |
| TIMP1 | 1.83 | <0.0001 | TIMP1 | NM_003254 |
| WWOX | 1.81 | 0.0288 | WWOX | NM_016373 |
| ANXA5 | 1.80 | 0.0029 | ANXA5 | NM_001154 |
| FUS | 1.79 | 0.0179 | FUS | NM_004960 |
| PADI4 | 1.78 | 0.0168 | PADI4 | NM_012387 |
| RBX1 | 1.71 | 0.0082 | RBX1 | NM_014248 |
| CRIP2 | 1.71 | 0.0343 | CRIP2 | NM_001312 |
| HB-EGF | 1.69 | 0.0013 | HBEGF | NM_001945 |
| KCNH2 iso a/b | 1.69 | 0.0070 | KCNH2 | NM_000249 |
| SBA2 | 1.68 | 0.0066 | WSB2 | NM_018639 |
| RhoB | 1.67 | 0.0010 | RHOB | NM_004040 |
| VIM | 1.66 | 0.0010 | VIM | NM_003380 |
| LILRB3 | 1.66 | 0.0227 | LILRB3 | NM_006864 |
| UBC | 1.64 | 0.0051 | UBC | NM_021009 |
| p21 | 1.63 | 0.0032 | CDKN1A | NM_000389 |
| CCNE2 variant 1 | 1.62 | 0.0363 | CCNE2 | NM_057749 |
| RAB6C | 1.61 | 0.0107 | RAB6C | NM_032144 |
| MSH3 | 1.61 | 0.0213 | MSH3 | NM_002439 |
| AKT3 | 1.59 | 0.0003 | AKT3 | NM_005465 |
| PI3K | 1.58 | 0.0552 | PIK3C2B | NM_002646 |
| RAP1GDS1 | 1.57 | 0.0154 | RAP1GDS1 | NM_021159 |
| CTSB | 1.57 | 0.0250 | CTSB | NM_001908 |

TABLE 4A-continued

| Gene | Hazard Ratio | P Value | Official Symbol | Accession Number |
|---|---|---|---|---|
| PRDX6 | 1.57 | 0.0770 | PRDX6 | NM_004905 |
| NRP2 | 1.56 | 0.0005 | NRP2 | NM_003872 |
| DLC1 | 1.56 | 0.0026 | DLC1 | NM_006094 |
| BGN | 1.55 | 0.0006 | BGN | NM_001711 |
| SIR2 | 1.55 | 0.0016 | SIRT1 | NM_012238 |
| CALD1 | 1.53 | 0.0046 | CALD1 | NM_004342 |
| YWHAH | 1.53 | 0.0429 | YWHAH | NM_003405 |
| CDC42 | 1.52 | 0.0207 | CDC42 | NM_001791 |
| ITGA5 | 1.51 | 0.0004 | ITGA5 | NM_002205 |
| KLF6 | 1.51 | 0.0197 | KLF6 | NM_001300 |
| TLN1 | 1.51 | 0.0414 | TLN1 | NM_006289 |
| LAMC2 | 1.49 | 0.0017 | LAMC2 | NM_005562 |
| STC1 | 1.49 | 0.0040 | STC1 | NM_003155 |
| CDC42BPA | 1.49 | 0.0109 | CDC42BPA | NM_003607 |
| RBM5 | 1.49 | 0.0184 | RBM5 | NM_005778 |
| INHBB | 1.49 | 0.0310 | INHBB | NM_002193 |
| TGFBR1 | 1.49 | 0.0502 | TGFBR1 | NM_004612 |
| ADAM10 | 1.49 | 0.0819 | ADAM10 | NM_001110 |
| CEBPB | 1.48 | 0.0399 | CEBPB | NM_005194 |
| AKT1 | 1.48 | 0.0846 | AKT1 | NM_005163 |
| FYN | 1.47 | 0.0036 | FYN | NM_002037 |
| ARG | 1.47 | 0.0067 | ABL2 | NM_005158 |
| HIF1A | 1.47 | 0.0221 | HIF1A | NM_001530 |
| S100A1 | 1.47 | 0.0293 | S100A1 | NM_006271 |
| KRAS2 | 1.47 | 0.0958 | KRAS | NM_004985 |
| CTHRC1 | 1.46 | 0.0008 | CTHRC1 | NM_138455 |
| IGFBP7 | 1.46 | 0.0173 | IGFBP7 | NM_001553 |
| ROCK1 | 1.46 | 0.0326 | ROCK1 | NM_005406 |
| VEGFC | 1.46 | 0.0516 | VEGFC | NM_005429 |
| EPAS1 | 1.45 | 0.0316 | EPAS1 | NM_001430 |
| DUSP1 | 1.44 | 0.0008 | DUSP1 | NM_004417 |
| FST | 1.44 | 0.0340 | FST | NM_006350 |
| GADD45B | 1.43 | 0.0013 | GADD45B | NM_015675 |
| FLT4 | 1.43 | 0.0663 | FLT4 | NM_002020 |
| PTEN | 1.43 | 0.0760 | PTEN | NM_000314 |
| FAP | 1.42 | 0.0017 | FAP | NM_004460 |
| PDGFC | 1.42 | 0.0033 | PDGFC | NM_016205 |
| LOXL2 | 1.42 | 0.0115 | LOXL2 | NM_002318 |
| Pak1 | 1.42 | 0.0846 | PAK1 | NM_002576 |
| Grb10 | 1.41 | 0.0020 | GRB10 | NM_005311 |
| INHBA | 1.41 | 0.0036 | INHBA | NM_002192 |
| GJA1 | 1.41 | 0.0039 | GJA1 | NM_000165 |
| CTGF | 1.41 | 0.0053 | CTGF | NM_001901 |
| COL1A2 | 1.41 | 0.0057 | COL1A2 | NM_000089 |
| PTK2 | 1.40 | 0.0496 | PTK2 | NM_005607 |
| THBS1 | 1.39 | 0.0059 | THBS1 | NM_003246 |
| RANBP9 | 1.39 | 0.0333 | RANBP9 | NM_005493 |
| RANBP2 | 1.39 | 0.0988 | RANBP2 | NM_006267 |
| ITGAV | 1.38 | 0.0210 | ITGAV | NM_002210 |
| TIMP2 | 1.38 | 0.0285 | TIMP2 | NM_003255 |
| PTHR1 | 1.38 | 0.0297 | PTHR1 | NM_000316 |
| GADD45 | 1.38 | 0.0340 | GADD45A | NM_001924 |
| c-abl | 1.38 | 0.0526 | ABL1 | NM_005157 |
| EGR1 | 1.37 | 0.0097 | EGR1 | NM_001964 |
| NCAM1 | 1.37 | 0.0657 | NCAM1 | NM_000615 |
| VCL | 1.37 | 0.0845 | VCL | NM_003373 |
| LOX | 1.36 | 0.0026 | LOX | NM_002317 |
| SNAI2 | 1.36 | 0.0178 | SNAI2 | NM_003068 |
| SPARC | 1.36 | 0.0198 | SPARC | NM_003118 |
| CDH11 | 1.36 | 0.0233 | CDH11 | NM_001797 |
| NFKBp50 | 1.36 | 0.0767 | NFKB1 | NM_003998 |
| CYR61 | 1.35 | 0.0065 | CYR61 | NM_001554 |
| S100A4 | 1.35 | 0.0104 | S100A4 | NM_002961 |
| TAGLN | 1.35 | 0.0168 | TAGLN | NM_003186 |
| PCAF | 1.34 | 0.0327 | PCAF | NM_003884 |
| NOTCH2 | 1.34 | 0.0390 | NOTCH2 | NM_024408 |
| LRP5 | 1.34 | 0.0722 | LRP5 | NM_002335 |
| SI | 1.34 | 0.0787 | SI | NM_001041 |
| GBP2 | 1.33 | 0.0139 | GBP2 | NM_004120 |
| Bcl2 | 1.33 | 0.0143 | BCL2 | NM_000633 |
| MCP1 | 1.33 | 0.0159 | CCL2 | NM_002982 |
| EPHA2 | 1.33 | 0.0184 | EPHA2 | NM_004431 |
| PRKCA | 1.33 | 0.0329 | PRKCA | NM_002737 |
| TIMP3 | 1.33 | 0.0337 | TIMP3 | NM_000362 |
| ANGPT2 | 1.33 | 0.0476 | ANGPT2 | NM_001147 |
| CTSD | 1.33 | 0.0766 | CTSD | NM_001909 |
| SEMA3F | 1.33 | 0.0931 | SEMA3F | NM_004186 |
| BCAS1 | 1.32 | 0.0044 | BCAS1 | NM_003657 |
| ANXA1 | 1.32 | 0.0458 | ANXA1 | NM_000700 |
| KRT19 | 1.32 | 0.0535 | KRT19 | NM_002276 |
| PTPRJ | 1.32 | 0.0618 | PTPRJ | NM_002843 |
| CAPG | 1.32 | 0.0641 | CAPG | NM_001747 |
| FOS | 1.31 | 0.0129 | FOS | NM_005252 |
| COL1A1 | 1.31 | 0.0236 | COL1A1 | NM_000088 |
| CXCR4 | 1.31 | 0.0251 | CXCR4 | NM_003467 |
| TUBB | 1.31 | 0.0354 | TUBB2 | NM_001069 |
| PIM1 | 1.31 | 0.0373 | PIM1 | NM_002648 |
| IGFBP5 | 1.31 | 0.0477 | IGFBP5 | NM_000599 |
| AP-1 (JUN official) | 1.31 | 0.0519 | JUN | NM_002228 |
| GCNT1 | 1.31 | 0.0534 | GCNT1 | NM_001490 |
| MAX | 1.31 | 0.0650 | MAX | NM_002382 |
| PAI1 | 1.30 | 0.0017 | SERPINE1 | NM_000602 |
| SLPI | 1.30 | 0.0176 | SLPI | NM_003064 |
| IGFBP3 | 1.30 | 0.0320 | IGFBP3 | NM_000598 |
| DAPK1 | 1.30 | 0.0402 | DAPK1 | NM_004938 |
| ID3 | 1.30 | 0.0442 | ID3 | NM_002167 |
| EFNA1 | 1.30 | 0.0623 | EFNA1 | NM_004428 |
| AKAP12 | 1.29 | 0.0162 | AKAP12 | NM_005100 |
| PDGFB | 1.29 | 0.0242 | PDGFB | NM_002608 |
| CD68 | 1.29 | 0.0524 | CD68 | NM_001251 |
| FGFR1 | 1.29 | 0.0709 | FGFR1 | NM_023109 |
| GSK3B | 1.29 | 0.0765 | GSK3B | NM_002093 |
| CXCL12 | 1.28 | 0.0129 | CXCL12 | NM_000609 |
| DPYD | 1.28 | 0.0186 | DPYD | NM_000110 |
| LAMA3 | 1.28 | 0.0193 | LAMA3 | NM_000227 |
| MRP3 | 1.28 | 0.0384 | ABCC3 | NM_003786 |
| ABCC5 | 1.28 | 0.0402 | ABCC5 | NM_005688 |
| PDGFA | 1.28 | 0.0482 | | NM_002607 |
| XPA | 1.28 | 0.0740 | XPA | NM_000380 |
| NDRG1 | 1.28 | 0.0786 | NDRG1 | NM_006096 |
| FES | 1.27 | 0.0458 | FES | NM_002005 |
| CTSL | 1.27 | 0.0485 | CTSL | NM_001912 |
| IL6 | 1.27 | 0.0606 | IL6 | NM_000600 |
| SFRP2 | 1.26 | 0.0085 | SFRP2 | NM_003013 |
| Maspin | 1.26 | 0.0096 | SERPINB5 | NM_002639 |
| TGFBI | 1.26 | 0.0470 | TGFBI | NM_000358 |
| NOS3 | 1.26 | 0.0978 | NOS3 | NM_000603 |
| HSPA1A | 1.25 | 0.0161 | HSPA1A | NM_005345 |
| S100A8 | 1.25 | 0.0180 | S100A8 | NM_002964 |
| HOXB7 | 1.25 | 0.0396 | HOXB7 | NM_004502 |
| P14ARF | 1.25 | 0.0697 | | S78535 |
| WISP1 | 1.25 | 0.0712 | WISP1 | NM_003882 |
| ID4 | 1.25 | 0.0883 | ID4 | NM_001546 |
| SFRP4 | 1.24 | 0.0200 | SFRP4 | NM_003014 |
| FZD6 | 1.24 | 0.0220 | FZD6 | NM_003506 |
| EGR3 | 1.24 | 0.0237 | EGR3 | NM_004430 |
| ALDH1A1 | 1.24 | 0.0258 | ALDH1A1 | NM_000689 |
| CRYAB | 1.23 | 0.0394 | CRYAB | NM_001885 |
| TGFB3 | 1.23 | 0.0541 | TGFB3 | NM_003239 |
| ANTXR1 | 1.23 | 0.0661 | ANTXR1 | NM_032208 |
| KLK6 | 1.22 | 0.0211 | KLK6 | NM_002774 |
| ILT-2 | 1.22 | 0.0676 | LILRB1 | NM_006669 |
| EMP1 | 1.22 | 0.0871 | EMP1 | NM_001423 |
| PLAUR | 1.22 | 0.0943 | PLAUR | NM_002659 |
| S100A2 | 1.20 | 0.0100 | S100A2 | NM_005978 |
| MMP7 | 1.19 | 0.0810 | MMP7 | NM_002423 |
| OPN_osteopontin | 1.17 | 0.0231 | SPP1 | NM_000582 |
| FABP4 | 1.17 | 0.0325 | FABP4 | NM_001442 |
| KLK10 | 1.17 | 0.0452 | KLK10 | NM_002776 |
| PS2 | 1.16 | 0.0140 | TFF1 | NM_003225 |
| STMY3 | 1.15 | 0.0850 | MMP11 | NM_005940 |
| REG4 | 1.14 | 0.0042 | REG4 | NM_032044 |
| MUC2 | 1.09 | 0.0370 | MUC2 | NM_002457 |

Table 4B shows associations between clinical outcome and gene expression for those genes which demonstrated a Hazard Ratio<1.0 and for which p<0.1. Univariate Cox Proportional Hazards Regression analysis was applied in combined Stage II (Duke's B) and Stage III (Duke's C) patients using DRFI as the metric for clinical outcome.

| Gene | Hazard Ratio | P Value | OfficialSymbol | Accession Number |
|---|---|---|---|---|
| HSPA8 | 0.51 | 0.0261 | HSPA8 | NM_006597 |
| RPS13 | 0.58 | 0.0089 | RPS13 | NM_001017 |
| RPLPO | 0.63 | 0.0324 | RPLP0 | NM_001002 |
| NDUFS3 | 0.66 | 0.0142 | NDUFS3 | NM_004551 |
| LMNB1 | 0.67 | 0.0202 | LMNB1 | NM_005573 |
| ST14 | 0.67 | 0.0206 | ST14 | NM_021978 |
| BRCA1 | 0.68 | 0.0032 | BRCA1 | NM_007295 |
| TMSB4X | 0.68 | 0.0075 | TMSB4X | NM_021109 |
| DHFR | 0.68 | 0.0356 | DHFR | NM_000791 |
| SKP2 | 0.69 | 0.0248 | SKP2 | NM_005983 |
| TCF-1 | 0.70 | 0.0015 | TCF1 | NM_000545 |
| CDC20 | 0.70 | 0.0067 | CDC20 | NM_001255 |
| SLC25A3 | 0.70 | 0.0418 | SLC25A3 | NM_213611 |
| NME1 | 0.72 | 0.0503 | NME1 | NM_000269 |
| RRM1 | 0.72 | 0.0850 | RRM1 | NM_001033 |
| MCM2 | 0.76 | 0.0168 | MCM2 | NM_004526 |
| ABCC6 | 0.76 | 0.0445 | ABCC6 | NM_001171 |
| CKS2 | 0.76 | 0.0869 | CKS2 | NM_001827 |
| EPHB2 | 0.77 | 0.0174 | EPHB2 | NM_004442 |
| C20 orf1 | 0.77 | 0.0716 | TPX2 | NM_012112 |
| CSEL1 | 0.77 | 0.0725 | CSE1L | NM_001316 |
| NFKBp65 | 0.78 | 0.0957 | RELA | NM_021975 |
| AURKB | 0.79 | 0.0742 | AURKB | NM_004217 |
| CMYC | 0.82 | 0.0901 | MYC | NM_002467 |
| Cdx2 | 0.85 | 0.0510 | CDX2 | NM_001265 |
| EREG | 0.85 | 0.0730 | EREG | NM_001432 |
| AREG | 0.86 | 0.0365 | AREG | NM_001657 |

Table 5A shows associations between gene expression and RFI, controlling for particular demographic and clinical characteristics of patients included in the analysis. All genes are listed whose expression correlates with RFI (p<0.1) and which demonstrated a Hazard Ratio>1 in a multivariate analysis including the following variables: tumor location, surgery, tumor grade, nodes examined, and number of positive nodes.

TABLE 5A

| Gene | HR | LR Chi-Square | DF | P-Value |
|---|---|---|---|---|
| RARB | 2.06780 | 4.23265 | 1 | 0.03965 |
| CYP3A4 | 1.85387 | 7.99462 | 1 | 0.00469 |
| ANXA2 | 1.80012 | 10.84166 | 1 | 0.00099 |
| COX2 | 1.79051 | 4.52307 | 1 | 0.03344 |
| RhoC | 1.73986 | 9.97133 | 1 | 0.00159 |
| MAPK14 | 1.68382 | 8.04253 | 1 | 0.00457 |
| UBC | 1.67323 | 11.69444 | 1 | 0.00063 |
| RhoB | 1.66612 | 15.92497 | 1 | 0.00007 |
| ITGB1 | 1.65796 | 8.18638 | 1 | 0.00422 |
| KRAS2 | 1.63873 | 6.80447 | 1 | 0.00909 |
| NTN1 | 1.61833 | 5.43469 | 1 | 0.01974 |
| ATP5E | 1.60990 | 4.93660 | 1 | 0.02629 |
| G-Catenin | 1.58482 | 9.24422 | 1 | 0.00236 |
| STC1 | 1.58163 | 11.10757 | 1 | 0.00086 |
| SPINT2 | 1.52653 | 6.17276 | 1 | 0.01297 |
| Claudin 4 | 1.50290 | 12.29943 | 1 | 0.00045 |
| IGFBP7 | 1.48789 | 9.62569 | 1 | 0.00192 |
| NCAM1 | 1.48294 | 5.11428 | 1 | 0.02373 |
| TIMP1 | 1.46045 | 9.98492 | 1 | 0.00158 |
| CEBPB | 1.46025 | 5.23659 | 1 | 0.02212 |
| KCNH2 iso a/b | 1.44616 | 3.97304 | 1 | 0.04623 |
| TMSB10 | 1.43107 | 4.65463 | 1 | 0.03097 |
| VEGFC | 1.41860 | 4.66904 | 1 | 0.03071 |
| HB-EGF | 1.41757 | 7.00399 | 1 | 0.00813 |
| FST | 1.41061 | 5.59674 | 1 | 0.01799 |
| LAMC2 | 1.40860 | 11.33697 | 1 | 0.00076 |
| GADD45B | 1.40671 | 12.26323 | 1 | 0.00046 |
| AKT3 | 1.40161 | 10.13028 | 1 | 0.00146 |
| EFNA1 | 1.40048 | 8.86645 | 1 | 0.00290 |
| p21 | 1.39939 | 5.42981 | 1 | 0.01980 |
| INHBA | 1.38204 | 11.03909 | 1 | 0.00089 |
| CALD1 | 1.38009 | 6.93406 | 1 | 0.00846 |
| DUSP1 | 1.36464 | 13.04379 | 1 | 0.00030 |
| HSPG2 | 1.36387 | 4.11749 | 1 | 0.04244 |
| GJB2 | 1.36358 | 8.42204 | 1 | 0.00371 |
| EPAS1 | 1.36323 | 4.74318 | 1 | 0.02941 |
| BGN | 1.35821 | 7.66947 | 1 | 0.00562 |
| TIMP2 | 1.35571 | 5.78791 | 1 | 0.01614 |
| A-Catenin | 1.35566 | 4.35623 | 1 | 0.03687 |
| LOXL2 | 1.35470 | 7.23663 | 1 | 0.00714 |
| DKK1 | 1.35126 | 3.88504 | 1 | 0.04872 |
| ITGAV | 1.34899 | 8.03554 | 1 | 0.00459 |
| CGB | 1.34840 | 7.06221 | 1 | 0.00787 |
| EGR1 | 1.33424 | 8.41855 | 1 | 0.00371 |
| TIMP3 | 1.33197 | 6.28550 | 1 | 0.01217 |
| VIM | 1.33196 | 4.92198 | 1 | 0.02652 |
| TGFBI | 1.32511 | 8.30278 | 1 | 0.00396 |
| FXYD5 | 1.32500 | 6.22751 | 1 | 0.01258 |
| VEGF | 1.32291 | 4.93825 | 1 | 0.02627 |
| ADAMTS12 | 1.31794 | 7.46749 | 1 | 0.00628 |
| SLPI | 1.31565 | 8.38324 | 1 | 0.00379 |
| DLC1 | 1.30862 | 5.51638 | 1 | 0.01884 |
| HOXB7 | 1.30822 | 8.04076 | 1 | 0.00457 |
| TMEPAI | 1.30395 | 8.43736 | 1 | 0.00368 |
| IGFBP5 | 1.30260 | 5.44022 | 1 | 0.01968 |
| CDC42BPA | 1.30167 | 4.20771 | 1 | 0.04024 |
| PDGFA | 1.29760 | 5.54964 | 1 | 0.01848 |
| GSTp | 1.29594 | 3.96268 | 1 | 0.04652 |
| FOS | 1.29427 | 8.42847 | 1 | 0.00369 |
| PDGFC | 1.28813 | 6.81737 | 1 | 0.00903 |
| IGFBP3 | 1.28701 | 6.33625 | 1 | 0.01183 |
| LOX | 1.28433 | 8.15598 | 1 | 0.00429 |
| SPARC | 1.28260 | 4.75876 | 1 | 0.02915 |
| EFNB2 | 1.27720 | 4.71247 | 1 | 0.02994 |
| Maspin | 1.27645 | 10.57657 | 1 | 0.00115 |
| THBS1 | 1.27619 | 6.61087 | 1 | 0.01014 |
| TAGLN | 1.26904 | 5.15123 | 1 | 0.02323 |
| VEGF_altsplice1 | 1.26734 | 5.29282 | 1 | 0.02141 |
| S100P | 1.26586 | 9.88713 | 1 | 0.00166 |
| HSPA1A | 1.26209 | 8.59704 | 1 | 0.00337 |
| MAD | 1.26112 | 3.96163 | 1 | 0.04655 |
| ANGPT2 | 1.25701 | 3.91148 | 1 | 0.04796 |
| PRKCA | 1.24853 | 4.69452 | 1 | 0.03026 |
| F3 | 1.24848 | 5.06788 | 1 | 0.02437 |
| FAP | 1.24657 | 5.19589 | 1 | 0.02264 |
| BRK | 1.24507 | 5.44048 | 1 | 0.01968 |
| CD68 | 1.23943 | 4.02530 | 1 | 0.04482 |
| NR4A1 | 1.23772 | 7.09548 | 1 | 0.00773 |
| CTHRC1 | 1.23465 | 5.21100 | 1 | 0.02244 |
| SLC2A1 | 1.22967 | 5.22364 | 1 | 0.02228 |
| Grb10 | 1.22209 | 4.12811 | 1 | 0.04218 |
| p16-INK4 | 1.21325 | 4.44296 | 1 | 0.03505 |
| MDK | 1.21116 | 5.25025 | 1 | 0.02194 |
| CYR61 | 1.19995 | 4.14452 | 1 | 0.04177 |
| LAMA3 | 1.19794 | 4.33073 | 1 | 0.03743 |
| FOXO3A | 1.19557 | 4.20079 | 1 | 0.04041 |
| EFNA3 | 1.19439 | 5.51728 | 1 | 0.01883 |
| CRYAB | 1.17514 | 3.90435 | 1 | 0.04816 |
| CEACAM6 | 1.16804 | 3.96486 | 1 | 0.04646 |
| OPN_osteopontin | 1.16112 | 5.50891 | 1 | 0.01892 |
| KLK10 | 1.15851 | 5.65625 | 1 | 0.01739 |
| SFRP2 | 1.15773 | 4.02893 | 1 | 0.04473 |
| KLK6 | 1.15163 | 4.65953 | 1 | 0.03088 |
| S100A2 | 1.14185 | 3.94284 | 1 | 0.04707 |
| REG4 | 1.09037 | 4.16995 | 1 | 0.04115 |

Table 5B shows associations between gene expression and RFI, controlling for particular demographic and clinical characteristics of patients included in the analysis. All genes are listed whose expression correlates with RFI (p<0.1) and which demonstrated a Hazard Ratio<1 in a multivariate analysis including the following variables: tumor location, surgery, tumor grade, nodes examined, and number of positive nodes.

TABLE 5B

| Gene | HR | LR Chi-Square | DF | P-Value |
|---|---|---|---|---|
| BFGF | 0.46674 | 6.95233 | 1 | 0.00837 |
| Fasl | 0.47324 | 4.08714 | 1 | 0.04321 |
| KLRK1 | 0.63331 | 10.28820 | 1 | 0.00134 |
| DHFR | 0.64947 | 7.64434 | 1 | 0.00570 |
| BRCA1 | 0.65247 | 15.21566 | 1 | 0.00010 |
| SLC25A3 | 0.67480 | 5.72977 | 1 | 0.01668 |
| RAD54L | 0.68215 | 5.38684 | 1 | 0.02029 |
| PPM1D | 0.68777 | 10.02879 | 1 | 0.00154 |
| CD80 | 0.69347 | 8.70087 | 1 | 0.00318 |
| ATP5A1 | 0.70467 | 4.06718 | 1 | 0.04372 |
| PRKCB1 | 0.73152 | 5.21950 | 1 | 0.02234 |
| KIF22 | 0.73945 | 5.13202 | 1 | 0.02349 |
| Chk1 | 0.75865 | 4.38139 | 1 | 0.03633 |
| TRAIL | 0.76430 | 4.12533 | 1 | 0.04225 |
| CDC20 | 0.77071 | 5.04557 | 1 | 0.02469 |
| DUT | 0.78196 | 4.13381 | 1 | 0.04203 |
| ABCB1 | 0.79434 | 5.33783 | 1 | 0.02087 |
| UMPS | 0.80011 | 4.65425 | 1 | 0.03098 |
| ING5 | 0.80230 | 4.04085 | 1 | 0.04441 |
| CMYC | 0.80757 | 4.26709 | 1 | 0.03886 |
| CBP1 | 0.83015 | 3.98302 | 1 | 0.04596 |
| AREG | 0.86091 | 4.94239 | 1 | 0.02621 |

Table 6 shows associations between gene expression and clinical outcome based on a nonlinear proportional hazards analysis, using a 2 degree-of-freedom natural spline. All genes are listed which demonstrated a departure from a strictly linear relationship (p<0.05) with RFI in combined Stage II (Duke's B) and Stage III (Duke's C) patients. The relationship between gene expression and RFI was not constant throughout the observed range of expression values in the study, e.g. increases in gene expression may have been related to increases in duration of RFI in one portion of the observed range and with decreases in duration of RFI in a different portion of the range.

TABLE 6

| Gene | P-Value | Official Symbol | Accession Number |
|---|---|---|---|
| PTHLH | 0.001 | PTHLH | NM_002820 |
| CDCA7 v2 | 0.002 | CDCA7 | NM_145810 |
| CREBBP | 0.002 | CREBBP | NM_004380 |
| KLF5 | 0.002 | KLF5 | NM_001730 |
| LAMB3 | 0.004 | LAMB3 | NM_000228 |
| TGFBR1 | 0.005 | TGFBR1 | NM_004612 |
| NR4A1 | 0.005 | NR4A1 | NM_002135 |
| Upa | 0.005 | PLAU | NM_002658 |
| Cad17 | 0.007 | CDH17 | NM_004063 |
| S100A4 | 0.008 | S100A4 | NM_002961 |
| A-Catenin | 0.008 | CTNNA1 | NM_001903 |
| EPHB2 | 0.009 | EPHB2 | NM_004442 |
| Axin 2 | 0.011 | AXIN2 | NM_004655 |
| PTPRJ | 0.011 | PTPRJ | NM_002843 |
| CAPN1 | 0.012 | CAPN1 | NM_005186 |
| CEGP1 | 0.013 | SCUBE2 | NM_020974 |
| APOC1 | 0.013 | APOC1 | NM_001645 |
| GBP1 | 0.015 | GBP1 | NM_002053 |
| SKP2 | 0.016 | SKP2 | NM_005983 |
| ATP5E | 0.016 | ATP5E | NM_006886 |
| GRIK1 | 0.017 | GRIK1 | NM_000830 |
| PRKR | 0.018 | EIF2AK2 | NM_002759 |
| FUT6 | 0.020 | FUT6 | NM_000150 |
| PFN2 | 0.020 | PFN2 | NM_053024 |
| ITGB4 | 0.021 | ITGB4 | NM_000213 |
| MADH7 | 0.021 | SMAD7 | NM_005904 |
| RALBP1 | 0.021 | RALBP1 | NM_006788 |
| AKT1 | 0.022 | AKT1 | NM_005163 |
| KLK6 | 0.022 | KLK6 | NM_002774 |
| PLK | 0.023 | PLK1 | NM_005030 |
| CYP2C8 | 0.025 | CYP2C8 | NM_000770 |

TABLE 6-continued

| Gene | P-Value | Official Symbol | Accession Number |
|---|---|---|---|
| BTF3 | 0.026 | BTF3 | NM_001207 |
| CCNE2 variant 1 | 0.026 | CCNE2 | NM_057749 |
| STMY3 | 0.030 | MMP11 | NM_005940 |
| NRP1 | 0.030 | NRP1 | NM_003873 |
| SIAT4A | 0.031 | ST3GAL1 | NM_003033 |
| SEMA3B | 0.033 | SEMA3B | NM_004636 |
| TRAG3 | 0.033 | CSAG2 | NM_004909 |
| HSPE1 | 0.035 | HSPE1 | NM_002157 |
| SBA2 | 0.036 | WSB2 | NM_018639 |
| TK1 | 0.036 | TK1 | NM_003258 |
| CCNB2 | 0.037 | CCNB2 | NM_004701 |
| TMEPAI | 0.037 | TMEPAI | NM_020182 |
| SPRY2 | 0.037 | SPRY2 | NM_005842 |
| AGXT | 0.038 | AGXT | NM_000030 |
| ALCAM | 0.038 | ALCAM | NM_001627 |
| HSPCA | 0.038 | HSPCA | NM_005348 |
| TIMP3 | 0.038 | TIMP3 | NM_000362 |
| DET1 | 0.039 | DET1 | NM_017996 |
| tusc4 | 0.040 | TUSC4 | NM_006545 |
| SNAI2 | 0.040 | SNAI2 | NM_003068 |
| CD28 | 0.040 | CD28 | NM_006139 |
| RNF11 | 0.041 | RNF11 | NM_014372 |
| PAI1 | 0.042 | SERPINE1 | NM_000602 |
| XRCC1 | 0.042 | XRCC1 | NM_006297 |
| EGLN1 | 0.044 | EGLN1 | NM_022051 |
| EGFR | 0.044 | EGFR | NM_005228 |
| HES6 | 0.044 | HES6 | NM_018645 |
| KCNK4 | 0.045 | KCNK4 | NM_016611 |
| CXCR4 | 0.047 | CXCR4 | NM_003467 |
| PTP4A3 | 0.048 | PTP4A3 | NM_007079 |
| p27 | 0.048 | CDKN1B | NM_004064 |
| MADH4 | 0.049 | SMAD4 | NM_005359 |
| ICAM1 | 0.049 | ICAM1 | NM_000201 |

Table 7 shows all genes exhibiting an interaction (p-value<0.05) with tumor stage. The data were modeled using a proportional hazards model of RFI with gene expression, tumor stage, and their interaction as predictors.

TABLE 7

| Gene | HR Stage II | HR Stage III | P-value for Interaction |
|---|---|---|---|
| ICAM2 | 1.49 | 0.68 | 0.0019 |
| CD24 | 1.26 | 0.84 | 0.0054 |
| PRDX6 | 2.29 | 0.73 | 0.0058 |
| HSD17B2 | 0.62 | 1.29 | 0.0072 |
| ALCAM | 1.61 | 0.94 | 0.0088 |
| SIR2 | 2.02 | 1.09 | 0.0089 |
| NUFIP1 | 1.32 | 0.79 | 0.0093 |
| EMR3 | 2.14 | 0.57 | 0.0127 |
| CDC20 | 0.56 | 0.98 | 0.0130 |
| MT3 | 1.37 | 0.79 | 0.0134 |
| CLTC | 1.80 | 0.71 | 0.0144 |
| CYR61 | 1.73 | 1.10 | 0.0145 |
| WIF | 1.34 | 0.78 | 0.0195 |
| TFF3 | 1.23 | 0.90 | 0.0209 |
| SOS1 | 1.46 | 0.79 | 0.0287 |
| TMSB4X | 1.34 | 0.74 | 0.0293 |
| CENPE | 3.05 | 0.85 | 0.0330 |
| CDH11 | 1.49 | 0.96 | 0.0339 |
| CAPG | 0.90 | 1.50 | 0.0348 |
| TP53BP1 | 1.54 | 0.93 | 0.0357 |
| MGAT5 | 1.25 | 0.73 | 0.0362 |
| MADH2 | 1.36 | 0.70 | 0.0393 |
| LOX | 1.58 | 1.11 | 0.0396 |
| DKK1 | 0.87 | 1.55 | 0.0415 |
| CKS1B | 0.31 | 1.75 | 0.0467 |
| MMP7 | 0.92 | 1.28 | 0.0471 |
| STAT5B | 1.28 | 0.86 | 0.0471 |
| CD28 | 0.69 | 1.25 | 0.0472 |

Second Analysis Study Results

Reference Gene Set for the second analysis was ATP5E, CLTC, GPX1, NEDD8, PGK1, UBB.

Table 1.2A shows associations for those genes whose increased expression is predictive of shorter Recurrence-Free Interval (RFI) based on univariate proportional hazards analysis.

Table 1.2B shows associations for those genes whose increased expression is predictive of longer Recurrence-Free Interval (RFI) based on univariate proportional hazards analysis.

Table 2.2A shows associations for those genes whose increased expression is predictive of decreased rate of Overall Survival (OS) based on univariate proportional hazards analysis.

Table 2.2B shows associations for those genes whose increased expression is predictive of increased rate of Overall Survival (OS) based on univariate proportional hazards analysis.

Table 3.2A shows associations for those genes whose increased expression is predictive of decreased rate of Disease Free Survival (DFS) based on univariate proportional hazards analysis.

Table 3.2B shows associations for those genes whose increased expression is predictive of increased rate of Disease Free Survival (DFS) based on univariate proportional hazards analysis.

Table 4.2A shows associations for those genes whose increased expression is predictive of shorter Distant Recurrence-Free Interval (DRFI) based on univariate proportional hazards analysis.

Table 4.2B shows associations for those genes whose increased expression is predictive of longer Distant Recurrence-Free Interval (DRFI) based on univariate proportional hazards analysis.

Table 5.2A shows associations between gene expression and RFI for those genes whose increased expression is predictive of shorter Recurrence-Free Interval (RFI), based on a multivariate analysis controlling for particular demographic and clinical characteristics of patients included in the analysis.

Table 5.2B shows associations between gene expression and RFI for those genes whose increased expression is predictive of longer Recurrence-Free Interval (RFI), based on a multivariate analysis controlling for particular demographic and clinical characteristics of patients included in the analysis.

Table 6.2 shows genes for which an association between gene expression and clinical outcome was identified based on a nonlinear proportional hazards analysis, using a 2 degree-of-freedom natural spline.

Table 7.2 shows all genes exhibiting an interaction (p-value<0.05) with tumor stage.

Table 1.2A shows associations between clinical outcome and gene expression for those genes which demonstrated a Hazard Ratio>1.0 and for which p<0.1. Univariate Cox Proportional Hazards Regression analysis was applied in combined Stage II (Duke's B) and Stage III (Duke's C) patients using RFI as the metric for clinical outcome.

| Gene | Hazard Ratio | P Value | Official Symbol | Accession Number |
|---|---|---|---|---|
| RARB | 2.22 | 0.0294 | RARB | NM_016152 |
| ITGB1 | 2.04 | 0.0002 | ITGB1 | NM_002211 |
| ANXA2 | 1.78 | 0.0003 | ANXA2 | NM_004039 |
| CYP3A4 | 1.68 | 0.0075 | CYP3A4 | NM_017460 |
| COX2 | 1.64 | 0.0604 | PTGS2 | NM_000963 |
| KRAS2 | 1.62 | 0.0064 | KRAS | NM_004985 |
| TJP1 | 1.58 | 0.0751 | TJP1 | NM_003257 |
| KIAA0125 | 1.58 | 0.0889 | KIAA0125 | NM_014792 |
| RhoB | 1.57 | 0.0002 | RHOB | NM_004040 |
| RhoC | 1.56 | 0.0059 | RHOC | NM_175744 |
| NTN1 | 1.54 | 0.0336 | NTN1 | NM_004822 |
| ANXA5 | 1.52 | 0.0086 | ANXA5 | NM_001154 |
| TIMP1 | 1.52 | <.0001 | TIMP1 | NM_003254 |
| AKT3 | 1.50 | <.0001 | AKT3 | NM_005465 |
| CALD1 | 1.48 | 0.0007 | CALD1 | NM_004342 |
| IGFBP7 | 1.46 | 0.0023 | IGFBP7 | NM_001553 |
| CYP1B1 | 1.45 | 0.0222 | CYP1B1 | NM_000104 |
| BGN | 1.44 | 0.0002 | BGN | NM_001711 |
| VEGFC | 1.44 | 0.0151 | VEGFC | NM_005429 |
| DLC1 | 1.44 | 0.0014 | DLC1 | NM_006094 |
| SI | 1.42 | 0.0086 | SI | NM_001041 |
| TIMP2 | 1.42 | 0.0022 | TIMP2 | NM_003255 |
| CDC42BPA | 1.41 | 0.0038 | CDC42BPA | NM_003607 |
| LAMC2 | 1.40 | 0.0004 | LAMC2 | NM_005562 |
| ITGAV | 1.40 | 0.0019 | ITGAV | NM_002210 |
| CTSB | 1.40 | 0.0357 | CTSB | NM_001908 |
| DUSP1 | 1.39 | <.0001 | DUSP1 | NM_004417 |
| TLN1 | 1.39 | 0.0335 | TLN1 | NM_006289 |
| CCNE2 variant 1 | 1.39 | 0.0708 | CCNE2 | NM_057749 |
| TIMP3 | 1.38 | 0.0023 | TIMP3 | NM_000362 |
| GHI BRAF mut4 | 1.38 | 0.0537 | | GHI_BRAF_mut4 |
| HB-EGF | 1.38 | 0.0109 | HBEGF | NM_001945 |
| HSPG2 | 1.38 | 0.0258 | HSPG2 | NM_005529 |
| VIM | 1.37 | 0.0077 | VIM | NM_003380 |
| ROCK1 | 1.37 | 0.0168 | ROCK1 | NM_005406 |
| S100A1 | 1.36 | 0.0233 | S100A1 | NM_006271 |
| p21 | 1.36 | 0.0113 | CDKN1A | NM_000389 |
| CGB | 1.36 | 0.0023 | CGB | NM_000737 |
| UBC | 1.36 | 0.0137 | UBC | NM_021009 |
| GADD45B | 1.36 | 0.0003 | GADD45B | NM_015675 |
| INHBA | 1.35 | 0.0010 | INHBA | NM_002192 |
| VCL | 1.34 | 0.0286 | VCL | NM_003373 |
| SIR2 | 1.34 | 0.0049 | SIRT1 | NM_012238 |
| CD68 | 1.34 | 0.0042 | CD68 | NM_001251 |
| Maspin | 1.34 | <.0001 | SERPINB5 | NM_002639 |
| FST | 1.33 | 0.0326 | FST | NM_006350 |
| EPAS1 | 1.33 | 0.0306 | EPAS1 | NM_001430 |
| LOXL2 | 1.33 | 0.0076 | LOXL2 | NM_002318 |
| STC1 | 1.33 | 0.0119 | STC1 | NM_003155 |
| UNC5C | 1.32 | 0.0642 | UNC5C | NM_003728 |
| IGFBP5 | 1.32 | 0.0080 | IGFBP5 | NM_000599 |
| INHBB | 1.32 | 0.0643 | INHBB | NM_002193 |
| FAP | 1.32 | 0.0017 | FAP | NM_004460 |
| DKK1 | 1.31 | 0.0298 | DKK1 | NM_012242 |
| FYN | 1.31 | 0.0053 | FYN | NM_002037 |
| CTHRC1 | 1.31 | 0.0017 | CTHRC1 | NM_138455 |
| FOS | 1.31 | 0.0010 | FOS | NM_005252 |
| RBX1 | 1.31 | 0.0633 | RBX1 | NM_014248 |
| TAGLN | 1.31 | 0.0058 | TAGLN | NM_003186 |
| SBA2 | 1.31 | 0.0439 | WSB2 | NM_018639 |
| CYR61 | 1.30 | 0.0018 | CYR61 | NM_001554 |
| SPARC | 1.30 | 0.0117 | SPARC | NM_003118 |
| SNAI2 | 1.30 | 0.0076 | SNAI2 | NM_003068 |
| TMSB10 | 1.30 | 0.0757 | TMSB10 | NM_021103 |
| IGFBP3 | 1.30 | 0.0056 | IGFBP3 | NM_000598 |
| PDGFC | 1.29 | 0.0040 | PDGFC | NM_016205 |
| SLPI | 1.29 | 0.0026 | SLPI | NM_003064 |
| COL1A2 | 1.29 | 0.0087 | COL1A2 | NM_000089 |
| NRP2 | 1.29 | 0.0112 | NRP2 | NM_003872 |
| PRKCA | 1.29 | 0.0093 | PRKCA | NM_002737 |
| KLF6 | 1.29 | 0.0661 | KLF6 | NM_001300 |
| THBS1 | 1.28 | 0.0062 | THBS1 | NM_003246 |
| EGR1 | 1.28 | 0.0067 | EGR1 | NM_001964 |
| S100A4 | 1.28 | 0.0070 | S100A4 | NM_002961 |
| CXCR4 | 1.28 | 0.0089 | CXCR4 | NM_003467 |
| LAMA3 | 1.27 | 0.0024 | LAMA3 | NM_000227 |

-continued

| Gene | Hazard Ratio | P Value | Official Symbol | Accession Number |
|---|---|---|---|---|
| LOX | 1.26 | 0.0036 | LOX | NM_002317 |
| AKAP12 | 1.26 | 0.0046 | AKAP12 | NM_005100 |
| ADAMTS12 | 1.26 | 0.0109 | ADAMTS12 | NM_030955 |
| MCP1 | 1.25 | 0.0122 | CCL2 | NM_002982 |
| Grb10 | 1.25 | 0.0107 | GRB10 | NM_005311 |
| PTGER3 | 1.25 | 0.0240 | PTGER3 | NM_000957 |
| CRYAB | 1.25 | 0.0035 | CRYAB | NM_001885 |
| ANGPT2 | 1.25 | 0.0566 | ANGPT2 | NM_001147 |
| ANXA1 | 1.25 | 0.0353 | ANXA1 | NM_000700 |
| EphB6 | 1.24 | 0.0960 | EPHB6 | NM_004445 |
| PDGFB | 1.24 | 0.0139 | PDGFB | NM_002608 |
| COL1A1 | 1.24 | 0.0198 | COL1A1 | NM_000088 |
| TGFB3 | 1.23 | 0.0094 | TGFB3 | NM_003239 |
| CTGF | 1.23 | 0.0265 | CTGF | NM_001901 |
| PDGFA | 1.23 | 0.0312 |  | NM_002607 |
| HSPA1A | 1.23 | 0.0027 | HSPA1A | NM_005345 |
| EFNB2 | 1.23 | 0.0331 | EFNB2 | NM_004093 |
| CAPG | 1.23 | 0.0724 | CAPG | NM_001747 |
| TGFBI | 1.22 | 0.0231 | TGFBI | NM_000358 |
| SIAT4A | 1.22 | 0.0253 | ST3GAL1 | NM_003033 |
| LAT | 1.22 | 0.0307 | LAT | NM_014387 |
| ITGA5 | 1.22 | 0.0224 | ITGA5 | NM_002205 |
| GBP2 | 1.22 | 0.0225 | GBP2 | NM_004120 |
| ANTXR1 | 1.22 | 0.0204 | ANTXR1 | NM_032208 |
| ID4 | 1.22 | 0.0512 | ID4 | NM_001546 |
| SFRP2 | 1.22 | 0.0039 | SFRP2 | NM_003013 |
| TMEPAI | 1.21 | 0.0170 | TMEPAI | NM_020182 |
| CTSL | 1.21 | 0.0388 | CTSL | NM_001912 |
| KLK10 | 1.21 | 0.0007 | KLK10 | NM_002776 |
| FXYD5 | 1.21 | 0.0547 | FXYD5 | NM_014164 |
| GJB2 | 1.21 | 0.0356 | GJB2 | NM_004004 |
| P14ARF | 1.21 | 0.0451 |  | S78535 |
| DAPK1 | 1.21 | 0.0525 | DAPK1 | NM_004938 |
| SKP1A | 1.21 | 0.0663 | SKP1A | NM_006930 |
| SFRP4 | 1.21 | 0.0078 | SFRP4 | NM_003014 |
| KLK6 | 1.20 | 0.0048 | KLK6 | NM_002774 |
| GJA1 | 1.20 | 0.0345 | GJA1 | NM_000165 |
| HOXB7 | 1.20 | 0.0278 | HOXB7 | NM_004502 |
| NDRG1 | 1.20 | 0.0948 | NDRG1 | NM_006096 |
| PAI1 | 1.19 | 0.0061 | SERPINE1 | NM_000602 |
| CDH11 | 1.19 | 0.0762 | CDH11 | NM_001797 |
| EGR3 | 1.19 | 0.0149 | EGR3 | NM_004430 |
| EMP1 | 1.19 | 0.0533 | EMP1 | NM_001423 |
| FZD1 | 1.19 | 0.0671 | FZD1 | NM_003505 |
| ABCC5 | 1.19 | 0.0631 | ABCC5 | NM_005688 |
| S100P | 1.18 | 0.0160 | S100P | NM_005980 |
| OPN, osteopontin | 1.18 | 0.0030 | SPP1 | NM_000582 |
| p16-INK4 | 1.17 | 0.0503 |  | L27211 |
| NR4A1 | 1.17 | 0.0332 | NR4A1 | NM_002135 |
| TUBB | 1.17 | 0.0950 | TUBB2 | NM_001069 |
| SIAT7B | 1.17 | 0.0352 | ST6GALNAC2 | NM_006456 |
| ALDH1A1 | 1.17 | 0.0299 | ALDH1A1 | NM_000689 |
| F3 | 1.16 | 0.0654 | F3 | NM_001993 |
| SLC2A1 | 1.15 | 0.0806 | SLC2A1 | NM_006516 |
| CXCL12 | 1.13 | 0.0986 | CXCL12 | NM_000609 |
| STMY3 | 1.13 | 0.0518 | MMP11 | NM_005940 |
| S100A2 | 1.13 | 0.0303 | S100A2 | NM_005978 |
| FABP4 | 1.13 | 0.0363 | FABP4 | NM_001442 |
| REG4 | 1.11 | 0.0034 | REG4 | NM_032044 |
| pS2 | 1.09 | 0.0690 | TFF1 | NM_003225 |
| MUC2 | 1.06 | 0.0674 | MUC2 | NM_002457 |

Table 1.2B shows associations between clinical outcome and gene expression for those genes which demonstrated a Hazard Ratio<1.0 and for which p<0.1. Univariate Cox Proportional Hazards Regression analysis was applied in combined Stage II (Duke's B) and Stage III (Duke's C) patients using RFI as the metric for clinical outcome.

| Gene | Hazard Ratio | P Value | Official Symbol | Accession Number |
|---|---|---|---|---|
| ORC1L | 0.41 | 0.0623 | ORC1L | NM_004153 |
| E2F1 | 0.63 | 0.0006 | E2F1 | NM_005225 |
| HSPA8 | 0.63 | 0.0346 | HSPA8 | NM_006597 |
| RAD54L | 0.65 | 0.0026 | RAD54L | NM_003579 |
| BRCA1 | 0.68 | 0.0001 | BRCA1 | NM_007295 |
| SLC25A3 | 0.70 | 0.0100 | SLC25A3 | NM_213611 |
| PPM1D | 0.71 | 0.0025 | PPM1D | NM_003620 |
| DHFR | 0.71 | 0.0106 | DHFR | NM_000791 |
| SKP2 | 0.72 | 0.0087 | SKP2 | NM_005983 |
| FASN | 0.73 | 0.0070 | FASN | NM_004104 |
| HNRPD | 0.73 | 0.0611 | HNRPD | NM_031370 |
| ENO1 | 0.74 | 0.0432 | ENO1 | NM_001428 |
| C20 orf1 | 0.74 | 0.0086 | TPX2 | NM_012112 |
| BRCA2 | 0.75 | 0.0515 | BRCA2 | NM_000059 |
| DDB1 | 0.75 | 0.0639 | DDB1 | NM_001923 |
| KIF22 | 0.76 | 0.0127 | KIF22 | NM_007317 |
| RPLPO | 0.76 | 0.0330 | RPLP0 | NM_001002 |
| Chk1 | 0.76 | 0.0164 | CHEK1 | NM_001274 |
| ST14 | 0.77 | 0.0392 | ST14 | NM_021978 |
| Bax | 0.77 | 0.0502 | BAX | NM_004324 |
| TCF-1 | 0.78 | 0.0023 | TCF1 | NM_000545 |
| LMNB1 | 0.78 | 0.0458 | LMNB1 | NM_005573 |
| RRM1 | 0.78 | 0.0693 | RRM1 | NM_001033 |
| CSEL1 | 0.79 | 0.0261 | CSE1L | NM_001316 |
| CDC20 | 0.79 | 0.0274 | CDC20 | NM_001255 |
| PRDX2 | 0.79 | 0.0930 | PRDX2 | NM_005809 |
| RPS13 | 0.79 | 0.0906 | RPS13 | NM_001017 |
| RAF1 | 0.80 | 0.0717 | RAF1 | NM_002880 |
| CMYC | 0.80 | 0.0095 | MYC | NM_002467 |
| UBE2M | 0.80 | 0.0390 | UBE2M | NM_003969 |
| CKS2 | 0.80 | 0.0596 | CKS2 | NM_001827 |
| NME1 | 0.80 | 0.0694 | NME1 | NM_000269 |
| c-myb (MYB official) | 0.80 | 0.0082 | MYB | NM_005375 |
| CD80 | 0.80 | 0.0688 | CD80 | NM_005191 |
| CDCA7 v2 | 0.81 | 0.0164 | CDCA7 | NM_145810 |
| EFP | 0.81 | 0.0387 | TRIM25 | NM_005082 |
| CCNE2 | 0.81 | 0.0405 | CCNE2 | NM_057749 |
| SURV | 0.81 | 0.0573 | BIRC5 | NM_001168 |
| RRM2 | 0.82 | 0.0181 | RRM2 | NM_001034 |
| ABCC6 | 0.82 | 0.0464 | ABCC6 | NM_001171 |
| UMPS | 0.82 | 0.0371 | UMPS | NM_000373 |
| PI3KC2A | 0.82 | 0.0855 | PIK3C2A | NM_002645 |
| NOTCH1 | 0.82 | 0.0222 | NOTCH1 | NM_017617 |
| EIF4E | 0.82 | 0.0928 | EIF4E | NM_001968 |
| EPHB2 | 0.82 | 0.0183 | EPHB2 | NM_004442 |
| AREG | 0.83 | 0.0012 | AREG | NM_001657 |
| EREG | 0.83 | 0.0059 | EREG | NM_001432 |
| MYBL2 | 0.83 | 0.0234 | MYBL2 | NM_002466 |
| ABCB1 | 0.83 | 0.0342 | ABCB1 | NM_000927 |
| HRAS | 0.83 | 0.0708 | HRAS | NM_005343 |
| SLC7A5 | 0.84 | 0.0547 | SLC7A5 | NM_003486 |
| MAD2L1 | 0.84 | 0.0653 | MAD2L1 | NM_002358 |
| ING5 | 0.85 | 0.0920 | ING5 | NM_032329 |
| Ki-67 | 0.85 | 0.0562 | MKI67 | NM_002417 |
| MCM2 | 0.85 | 0.0671 | MCM2 | NM_004526 |
| Cdx2 | 0.88 | 0.0430 | CDX2 | NM_001265 |
| HES6 | 0.89 | 0.0966 | HES6 | NM_018645 |
| PTPRO | 0.89 | 0.0664 | PTPRO | NM_030667 |
| cripto (TDGF1 official) | 0.90 | 0.0781 | TDGF1 | NM_003212 |

Table 2.2A shows associations between clinical outcome and gene expression for those genes which demonstrated a Hazard Ratio>1.0 and for which p<0.1. Univariate Cox Proportional Hazards Regression analysis was applied in combined Stage II (Duke's B) and Stage III (Duke's C) patients using OS as the metric for clinical outcome.

| Gene | Hazard Ratio | P Value | Official Symbol | Accession Number |
|---|---|---|---|---|
| RhoC | 1.66 | 0.0002 | RHOC | NM_175744 |
| ITGB1 | 1.59 | 0.0049 | ITGB1 | NM_002211 |
| ANXA2 | 1.58 | 0.0004 | ANXA2 | NM_004039 |
| CYP3A4 | 1.49 | 0.0114 | CYP3A4 | NM_017460 |
| p21 | 1.49 | <.0001 | CDKN1A | NM_000389 |
| HMLH | 1.42 | 0.0555 | MLH1 | NM_000249 |
| VEGFC | 1.41 | 0.0095 | VEGFC | NM_005429 |
| TGFBR1 | 1.40 | 0.0113 | TGFBR1 | NM_004612 |
| UBC | 1.38 | 0.0013 | UBC | NM_021009 |
| RhoB | 1.37 | 0.0016 | RHOB | NM_004040 |
| HSPG2 | 1.37 | 0.0111 | HSPG2 | NM_005529 |
| PFN1 | 1.35 | 0.0987 | PFN1 | NM_005022 |
| TIMP1 | 1.35 | 0.0008 | TIMP1 | NM_003254 |
| VCL | 1.33 | 0.0116 | VCL | NM_003373 |
| INHBB | 1.32 | 0.0265 | INHBB | NM_002193 |
| SPINT2 | 1.32 | 0.0358 | SPINT2 | NM_021102 |
| GHI BRAF mut4 | 1.31 | 0.0822 | | GHI_BRAF_mut4 |
| LAMC2 | 1.31 | 0.0007 | LAMC2 | NM_005562 |
| KCNH2 iso a/b | 1.31 | 0.0474 | KCNH2 | NM_000238 |
| UNC5C | 1.30 | 0.0417 | UNC5C | NM_003728 |
| CDC42 | 1.30 | 0.0122 | CDC42 | NM_001791 |
| UBL1 | 1.29 | 0.0169 | SUMO1 | NM_003352 |
| GADD45B | 1.29 | 0.0003 | GADD45B | NM_015675 |
| KRAS2 | 1.29 | 0.0774 | KRAS | NM_004985 |
| HB-EGF | 1.29 | 0.0219 | HBEGF | NM_001945 |
| DKK1 | 1.28 | 0.0304 | DKK1 | NM_012242 |
| FXYD5 | 1.28 | 0.0035 | FXYD5 | NM_014164 |
| CALD1 | 1.28 | 0.0107 | CALD1 | NM_004342 |
| ANXA5 | 1.27 | 0.0723 | ANXA5 | NM_001154 |
| HLA-G | 1.27 | 0.0732 | HLA-G | NM_002127 |
| DUSP1 | 1.27 | 0.0004 | DUSP1 | NM_004417 |
| LOXL2 | 1.27 | 0.0050 | LOXL2 | NM_002318 |
| CDC42BPA | 1.27 | 0.0155 | CDC42BPA | NM_003607 |
| BGN | 1.27 | 0.0039 | BGN | NM_001711 |
| LAMB3 | 1.27 | 0.0221 | LAMB3 | NM_000228 |
| EphB6 | 1.27 | 0.0373 | EPHB6 | NM_004445 |
| SHC1 | 1.27 | 0.0582 | SHC1 | NM_003029 |
| TIMP2 | 1.26 | 0.0126 | TIMP2 | NM_003255 |
| CTSB | 1.26 | 0.0748 | CTSB | NM_001908 |
| TIMP3 | 1.26 | 0.0072 | TIMP3 | NM_000362 |
| ID3 | 1.26 | 0.0033 | ID3 | NM_002167 |
| CAPG | 1.26 | 0.0162 | CAPG | NM_001747 |
| NRP1 | 1.26 | 0.0135 | NRP1 | NM_003873 |
| INHBA | 1.26 | 0.0021 | INHBA | NM_002192 |
| KLF6 | 1.25 | 0.0477 | KLF6 | NM_001300 |
| IGFBP7 | 1.25 | 0.0251 | IGFBP7 | NM_001553 |
| S100A1 | 1.25 | 0.0528 | S100A1 | NM_006271 |
| EPAS1 | 1.24 | 0.0382 | EPAS1 | NM_001430 |
| DLC1 | 1.24 | 0.0228 | DLC1 | NM_006094 |
| KLK10 | 1.24 | <.0001 | KLK10 | NM_002776 |
| SBA2 | 1.24 | 0.0493 | WSB2 | NM_018639 |
| SPARC | 1.24 | 0.0133 | SPARC | NM_003118 |
| GAGE4 | 1.23 | 0.0475 | GAGE4 | NM_001474 |
| HSPA1A | 1.23 | 0.0004 | HSPA1A | NM_005345 |
| SIR2 | 1.23 | 0.0179 | SIRT1 | NM_012238 |
| CGB | 1.23 | 0.0202 | CGB | NM_000737 |
| Grb10 | 1.22 | 0.0059 | GRB10 | NM_005311 |
| SNAI2 | 1.22 | 0.0145 | SNAI2 | NM_003068 |
| LAMA3 | 1.22 | 0.0019 | LAMA3 | NM_000227 |
| AKT3 | 1.22 | 0.0169 | AKT3 | NM_005465 |
| FYN | 1.22 | 0.0138 | FYN | NM_002037 |
| FOS | 1.22 | 0.0035 | FOS | NM_005252 |
| CTHRC1 | 1.21 | 0.0056 | CTHRC1 | NM_138455 |
| CTSD | 1.21 | 0.0506 | CTSD | NM_001909 |
| THY1 | 1.21 | 0.0290 | THY1 | NM_006288 |
| ANXA1 | 1.21 | 0.0339 | ANXA1 | NM_000700 |
| CD68 | 1.21 | 0.0227 | CD68 | NM_001251 |
| G-Catenin | 1.20 | 0.0789 | JUP | NM_002230 |
| PLK3 | 1.20 | 0.0081 | PLK3 | NM_004073 |
| STC1 | 1.20 | 0.0577 | STC1 | NM_003155 |
| TAGLN | 1.20 | 0.0238 | TAGLN | NM_003186 |
| VIM | 1.20 | 0.0632 | VIM | NM_003380 |
| HSPA1B | 1.20 | 0.0302 | HSPA1B | NM_005346 |
| LAT | 1.20 | 0.0184 | LAT | NM_014387 |
| KRT19 | 1.20 | 0.0309 | KRT19 | NM_002276 |
| IGFBP3 | 1.20 | 0.0167 | IGFBP3 | NM_000598 |
| BMP4 | 1.20 | 0.0035 | BMP4 | NM_001202 |
| KLK6 | 1.20 | 0.0014 | KLK6 | NM_002774 |
| THBS1 | 1.20 | 0.0206 | THBS1 | NM_003246 |
| TULP3 | 1.19 | 0.0344 | TULP3 | NM_003324 |
| ERK1 | 1.19 | 0.0522 | | Z11696 |
| CREBBP | 1.19 | 0.0866 | CREBBP | NM_004380 |
| S100A4 | 1.19 | 0.0259 | S100A4 | NM_002961 |
| PDGFB | 1.19 | 0.0205 | PDGFB | NM_002608 |
| EFNB2 | 1.19 | 0.0299 | EFNB2 | NM_004093 |
| LOX | 1.19 | 0.0104 | LOX | NM_002317 |
| PTK2 | 1.18 | 0.0983 | PTK2 | NM_005607 |
| IGFBP5 | 1.18 | 0.0544 | IGFBP5 | NM_000599 |
| APC | 1.18 | 0.0461 | APC | NM_000038 |
| DYRK1B | 1.18 | 0.0681 | DYRK1B | NM_004714 |
| NOTCH2 | 1.18 | 0.0533 | NOTCH2 | NM_024408 |
| Maspin | 1.18 | 0.0033 | SERPINB5 | NM_002639 |
| AKAP12 | 1.18 | 0.0195 | AKAP12 | NM_005100 |
| COL1A1 | 1.17 | 0.0417 | COL1A1 | NM_000088 |
| EMP1 | 1.17 | 0.0295 | EMP1 | NM_001423 |
| SIAT4A | 1.17 | 0.0311 | ST3GAL1 | NM_003033 |
| PAI1 | 1.17 | 0.0036 | SERPINE1 | NM_000602 |
| NR4A1 | 1.17 | 0.0117 | NR4A1 | NM_002135 |
| EGR1 | 1.17 | 0.0379 | EGR1 | NM_001964 |
| BRK | 1.17 | 0.0156 | PTK6 | NM_005975 |
| UNC5B | 1.17 | 0.0956 | UNC5B | NM_170744 |
| SR-A1 | 1.17 | 0.0512 | SR-A1 | NM_021228 |
| MRP3 | 1.16 | 0.0353 | ABCC3 | NM_003786 |
| hCRA a | 1.16 | 0.0878 | | U78556 |
| Upa | 1.16 | 0.0630 | PLAU | NM_002658 |
| BCAS1 | 1.16 | 0.0147 | BCAS1 | NM_003657 |
| PDGFC | 1.16 | 0.0375 | PDGFC | NM_016205 |
| COL1A2 | 1.16 | 0.0620 | COL1A2 | NM_000089 |
| CTGF | 1.16 | 0.0580 | CTGF | NM_001901 |
| MCP1 | 1.16 | 0.0463 | CCL2 | NM_002982 |
| RAB32 | 1.16 | 0.0686 | RAB32 | NM_006834 |
| SKP1A | 1.16 | 0.0842 | SKP1A | NM_006930 |
| FAP | 1.16 | 0.0443 | FAP | NM_004460 |
| EFNA1 | 1.16 | 0.0990 | EFNA1 | NM_004428 |
| HOXB7 | 1.15 | 0.0378 | HOXB7 | NM_004502 |
| CYR61 | 1.15 | 0.0452 | CYR61 | NM_001554 |
| TGFBI | 1.15 | 0.0591 | TGFBI | NM_000358 |
| TMEPAI | 1.15 | 0.0419 | TMEPAI | NM_020182 |
| SIN3A | 1.15 | 0.0853 | SIN3A | NM_015477 |
| S100A2 | 1.15 | 0.0038 | S100A2 | NM_005978 |
| PDGFA | 1.15 | 0.0840 | | NM_002607 |
| MMP7 | 1.15 | 0.0469 | MMP7 | NM_002423 |
| ANTXR1 | 1.15 | 0.0520 | ANTXR1 | NM_032208 |
| SLPI | 1.14 | 0.0755 | SLPI | NM_003064 |
| SFRP2 | 1.13 | 0.0253 | SFRP2 | NM_003013 |
| S100A8 | 1.13 | 0.0795 | S100A8 | NM_002964 |
| TP53I3 | 1.13 | 0.0973 | TP53I3 | NM_004881 |
| F3 | 1.13 | 0.0735 | F3 | NM_001993 |
| OPN, osteopontin | 1.12 | 0.0100 | SPP1 | NM_000582 |
| EGLN3 | 1.11 | 0.0883 | EGLN3 | NM_022073 |
| FZD6 | 1.11 | 0.0791 | FZD6 | NM_003506 |
| OSM | 1.10 | 0.0913 | OSM | NM_020530 |
| FABP4 | 1.10 | 0.0521 | FABP4 | NM_001442 |
| GSTT1 | 1.09 | 0.0837 | GSTT1 | NM_000853 |
| REG4 | 1.07 | 0.0300 | REG4 | NM_032044 |

Table 2.2B shows associations between clinical outcome and gene expression for those genes which demonstrated a Hazard Ratio<1.0 and for which p<0.1. Univariate Cox Proportional Hazards Regression analysis was applied in combined Stage II (Duke's B) and Stage III (Duke's C) patients using OS as the metric for clinical outcome.

| Gene | Hazard Ratio | P Value | Official Symbol | Accession Number |
|---|---|---|---|---|
| ORC1L | 0.52 | 0.0895 | ORC1L | NM_004153 |
| HSPA8 | 0.64 | 0.0164 | HSPA8 | NM_006597 |

-continued

| Gene | Hazard Ratio | P Value | Official Symbol | Accession Number |
|---|---|---|---|---|
| SKP2 | 0.71 | 0.0012 | SKP2 | NM_005983 |
| PRDX4 | 0.74 | 0.0202 | PRDX4 | NM_006406 |
| DHFR | 0.76 | 0.0111 | DHFR | NM_000791 |
| FGF18 | 0.76 | 0.0915 | FGF18 | NM_003862 |
| SLC25A3 | 0.76 | 0.0391 | SLC25A3 | NM_213611 |
| RRM1 | 0.77 | 0.0218 | RRM1 | NM_001033 |
| E2F1 | 0.78 | 0.0180 | E2F1 | NM_005225 |
| SURV | 0.79 | 0.0098 | BIRC5 | NM_001168 |
| PPM1D | 0.80 | 0.0154 | PPM1D | NM_003620 |
| CCNE2 | 0.80 | 0.0090 | CCNE2 | NM_057749 |
| BRCA1 | 0.80 | 0.0093 | BRCA1 | NM_007295 |
| ST14 | 0.80 | 0.0436 | ST14 | NM_021978 |
| c-myb (MYB official) | 0.81 | 0.0027 | MYB | NM_005375 |
| Chk1 | 0.81 | 0.0220 | CHEK1 | NM_001274 |
| C20 orf1 | 0.81 | 0.0305 | TPX2 | NM_012112 |
| EI24 | 0.81 | 0.0574 | EI24 | NM_004879 |
| CDC20 | 0.82 | 0.0234 | CDC20 | NM_001255 |
| TCF-1 | 0.82 | 0.0061 | TCF1 | NM_000545 |
| PPID | 0.83 | 0.0584 | PPID | NM_005038 |
| KIF22 | 0.83 | 0.0466 | KIF22 | NM_007317 |
| UBE2M | 0.83 | 0.0850 | UBE2M | NM_003969 |
| MRPL40 | 0.83 | 0.0716 | MRPL40 | NM_003776 |
| RPLPO | 0.84 | 0.0987 | RPLP0 | NM_001002 |
| LMNB1 | 0.84 | 0.0910 | LMNB1 | NM_005573 |
| DUT | 0.84 | 0.0401 | DUT | NM_001948 |
| CD44E | 0.84 | 0.0483 | | X55150 |
| MCM2 | 0.85 | 0.0214 | MCM2 | NM_004526 |
| CDC6 | 0.85 | 0.0235 | CDC6 | NM_001254 |
| AURKB | 0.85 | 0.0373 | AURKB | NM_004217 |
| SMARCA3 | 0.86 | 0.0562 | SMARCA3 | NM_003071 |
| CDCA7 v2 | 0.86 | 0.0435 | CDCA7 | NM_145810 |
| EPHB2 | 0.86 | 0.0281 | EPHB2 | NM_004442 |
| CMYC | 0.86 | 0.0441 | MYC | NM_002467 |
| ABCB1 | 0.86 | 0.0352 | ABCB1 | NM_000927 |
| Cdx2 | 0.87 | 0.0156 | CDX2 | NM_001265 |
| PPARG | 0.88 | 0.0655 | PPARG | NM_005037 |
| MYBL2 | 0.88 | 0.0667 | MYBL2 | NM_002466 |
| EREG | 0.89 | 0.0352 | EREG | NM_001432 |
| AREG | 0.90 | 0.0221 | AREG | NM_001657 |

Table 3.2A shows associations between clinical outcome and gene expression for those genes which demonstrated a Hazard Ratio>1.0 and for which p<0.1. Univariate Cox Proportional Hazards Regression analysis was applied in combined Stage II (Duke's B) and Stage III (Duke's C) patients using DFS as the metric for clinical outcome.

| Gene | Hazard Ratio | P Value | Official Symbol | Accession Number |
|---|---|---|---|---|
| ANXA2 | 1.67 | <.0001 | ANXA2 | NM_004039 |
| CYP3A4 | 1.59 | 0.0035 | CYP3A4 | NM_017460 |
| RhoC | 1.52 | 0.0010 | RHOC | NM_175744 |
| TJP1 | 1.44 | 0.0951 | TJP1 | NM_003257 |
| HB-EGF | 1.39 | 0.0023 | HBEGF | NM_001945 |
| p21 | 1.39 | 0.0006 | CDKN1A | NM_000389 |
| HMLH | 1.37 | 0.0678 | MLH1 | NM_000249 |
| ITGB1 | 1.37 | 0.0419 | ITGB1 | NM_002211 |
| UBC | 1.34 | 0.0024 | UBC | NM_021009 |
| VEGFC | 1.33 | 0.0246 | VEGFC | NM_005429 |
| TIMP1 | 1.33 | 0.0007 | TIMP1 | NM_003254 |
| CCNE2 variant 1 | 1.32 | 0.0745 | CCNE2 | NM_057749 |
| SPINT2 | 1.32 | 0.0224 | SPINT2 | NM_021102 |
| LAMC2 | 1.32 | 0.0002 | LAMC2 | NM_005562 |
| VCL | 1.31 | 0.0119 | VCL | NM_003373 |
| RhoB | 1.31 | 0.0049 | RHOB | NM_004040 |
| PKR2 | 1.30 | 0.0258 | PKM2 | NM_002654 |
| ANXA5 | 1.30 | 0.0406 | ANXA5 | NM_001154 |
| GADD45B | 1.30 | 0.0001 | GADD45B | NM_015675 |
| INHBB | 1.29 | 0.0368 | INHBB | NM_002193 |
| DUSP1 | 1.29 | <.0001 | DUSP1 | NM_004417 |
| KRAS2 | 1.28 | 0.0686 | KRAS | NM_004985 |
| KLF6 | 1.28 | 0.0284 | KLF6 | NM_001300 |
| IGFBP7 | 1.27 | 0.0103 | IGFBP7 | NM_001553 |
| GRIK1 | 1.27 | 0.0421 | GRIK1 | NM_000830 |
| DLC1 | 1.27 | 0.0084 | DLC1 | NM_006094 |
| FOS | 1.26 | 0.0003 | FOS | NM_005252 |
| HSPG2 | 1.26 | 0.0443 | HSPG2 | NM_005529 |
| INHBA | 1.26 | 0.0009 | INHBA | NM_002192 |
| TIMP3 | 1.26 | 0.0045 | TIMP3 | NM_000362 |
| BGN | 1.26 | 0.0035 | BGN | NM_001711 |
| CGB | 1.26 | 0.0172 | CGB | NM_000737 |
| HK1 | 1.26 | 0.0352 | HK1 | NM_000188 |
| SHC1 | 1.25 | 0.0562 | SHC1 | NM_003029 |
| STC1 | 1.25 | 0.0161 | STC1 | NM_003155 |
| LOXL2 | 1.24 | 0.0078 | LOXL2 | NM_002318 |
| CAPG | 1.24 | 0.0161 | CAPG | NM_001747 |
| UNC5B | 1.23 | 0.0204 | UNC5B | NM_170744 |
| MVP | 1.23 | 0.0729 | MVP | NM_017458 |
| CTSD | 1.23 | 0.0256 | CTSD | NM_001909 |
| EGR1 | 1.23 | 0.0041 | EGR1 | NM_001964 |
| LOX | 1.23 | 0.0017 | LOX | NM_002317 |
| CDC42BPA | 1.23 | 0.0278 | CDC42BPA | NM_003607 |
| GAGE4 | 1.23 | 0.0425 | GAGE4 | NM_001474 |
| CALD1 | 1.22 | 0.0239 | CALD1 | NM_004342 |
| FXYD5 | 1.22 | 0.0096 | FXYD5 | NM_014164 |
| EphB6 | 1.22 | 0.0825 | EPHB6 | NM_004445 |
| LAMB3 | 1.22 | 0.0444 | LAMB3 | NM_000228 |
| VEGF | 1.21 | 0.0267 | VEGF | NM_003376 |
| PDGFB | 1.21 | 0.0062 | PDGFB | NM_002608 |
| TIMP2 | 1.21 | 0.0292 | TIMP2 | NM_003255 |
| A-Catenin | 1.21 | 0.0598 | CTNNA1 | NM_001903 |
| IGFBP3 | 1.21 | 0.0081 | IGFBP3 | NM_000598 |
| CD68 | 1.21 | 0.0138 | CD68 | NM_001251 |
| S100A1 | 1.21 | 0.0886 | S100A1 | NM_006271 |
| SIAT4A | 1.21 | 0.0076 | ST3GAL1 | NM_003033 |
| HSPA1B | 1.21 | 0.0182 | HSPA1B | NM_005346 |
| DKK1 | 1.20 | 0.0900 | DKK1 | NM_012242 |
| SBA2 | 1.20 | 0.0733 | WSB2 | NM_018639 |
| SIR2 | 1.20 | 0.0250 | SIRT1 | NM_012238 |
| THBS1 | 1.20 | 0.0119 | THBS1 | NM_003246 |
| FYN | 1.20 | 0.0156 | FYN | NM_002037 |
| TULP3 | 1.20 | 0.0205 | TULP3 | NM_003324 |
| LAMA3 | 1.20 | 0.0026 | LAMA3 | NM_000227 |
| NR4A1 | 1.20 | 0.0022 | NR4A1 | NM_002135 |
| EFNA1 | 1.20 | 0.0258 | EFNA1 | NM_004428 |
| EMP1 | 1.20 | 0.0102 | EMP1 | NM_001423 |
| SPARC | 1.19 | 0.0333 | SPARC | NM_003118 |
| G-Catenin | 1.19 | 0.0761 | JUP | NM_002230 |
| CYR61 | 1.19 | 0.0103 | CYR61 | NM_001554 |
| Maspin | 1.19 | 0.0015 | SERPINB5 | NM_002639 |
| HSPA1A | 1.18 | 0.0018 | HSPA1A | NM_005345 |
| PTHR1 | 1.18 | 0.0856 | PTHR1 | NM_000316 |
| EPAS1 | 1.18 | 0.0789 | EPAS1 | NM_001430 |
| Grb10 | 1.18 | 0.0173 | GRB10 | NM_005311 |
| ERK1 | 1.18 | 0.0464 | | Z11696 |
| VIM | 1.18 | 0.0772 | VIM | NM_003380 |
| SNAI2 | 1.18 | 0.0379 | SNAI2 | NM_003068 |
| IGFBP5 | 1.17 | 0.0492 | IGFBP5 | NM_000599 |
| CTHRC1 | 1.17 | 0.0155 | CTHRC1 | NM_138455 |
| THY1 | 1.17 | 0.0562 | THY1 | NM_006288 |
| NRP1 | 1.17 | 0.0747 | NRP1 | NM_003873 |
| PTGER3 | 1.17 | 0.0493 | PTGER3 | NM_000957 |
| ID3 | 1.17 | 0.0437 | ID3 | NM_002167 |
| F3 | 1.17 | 0.0157 | F3 | NM_001993 |
| CTGF | 1.17 | 0.0394 | CTGF | NM_001901 |
| KRT19 | 1.17 | 0.0517 | KRT19 | NM_002276 |
| PAI1 | 1.17 | 0.0033 | SERPINE1 | NM_000602 |
| FAP | 1.17 | 0.0260 | FAP | NM_004460 |
| ANXA1 | 1.16 | 0.0688 | ANXA1 | NM_000700 |
| KLK10 | 1.16 | 0.0009 | KLK10 | NM_002776 |
| EFNB2 | 1.16 | 0.0447 | EFNB2 | NM_004093 |
| P14ARF | 1.16 | 0.0573 | | S78535 |
| MCP1 | 1.16 | 0.0359 | CCL2 | NM_002982 |
| PLK3 | 1.16 | 0.0296 | PLK3 | NM_004073 |
| ANTXR1 | 1.16 | 0.0243 | ANTXR1 | NM_032208 |
| ADAMTS12 | 1.16 | 0.0346 | ADAMTS12 | NM_030955 |

-continued

| Gene | Hazard Ratio | P Value | Official Symbol | Accession Number |
|---|---|---|---|---|
| EGR3 | 1.16 | 0.0109 | EGR3 | NM_004430 |
| APC | 1.16 | 0.0733 | APC | NM_000038 |
| PDGFC | 1.16 | 0.0326 | PDGFC | NM_016205 |
| BMP4 | 1.16 | 0.0151 | BMP4 | NM_001202 |
| HOXB7 | 1.15 | 0.0281 | HOXB7 | NM_004502 |
| NDRG1 | 1.15 | 0.0912 | NDRG1 | NM_006096 |
| Herstatin | 1.15 | 0.0380 | | AF177761 |
| TMEPAI | 1.15 | 0.0268 | TMEPAI | NM_020182 |
| IL6 | 1.15 | 0.0914 | IL6 | NM_000600 |
| PDGFA | 1.15 | 0.0599 | | NM_002607 |
| TGFBI | 1.15 | 0.0439 | TGFBI | NM_000358 |
| Upa | 1.15 | 0.0740 | PLAU | NM_002658 |
| S100A4 | 1.15 | 0.0621 | S100A4 | NM_002961 |
| SLPI | 1.15 | 0.0447 | SLPI | NM_003064 |
| KLK6 | 1.15 | 0.0112 | KLK6 | NM_002774 |
| COL1A1 | 1.15 | 0.0637 | COL1A1 | NM_000088 |
| GJB2 | 1.15 | 0.0604 | GJB2 | NM_004004 |
| PKD1 | 1.15 | 0.0939 | PKD1 | NM_000296 |
| TP53I3 | 1.15 | 0.0450 | TP53I3 | NM_004881 |
| PLAUR | 1.14 | 0.0477 | PLAUR | NM_002659 |
| TAGLN | 1.14 | 0.0739 | TAGLN | NM_003186 |
| COL1A2 | 1.14 | 0.0818 | COL1A2 | NM_000089 |
| S100A2 | 1.14 | 0.0045 | S100A2 | NM_005978 |
| AKT3 | 1.14 | 0.0949 | AKT3 | NM_005465 |
| SEMA3B | 1.13 | 0.0467 | SEMA3B | NM_004636 |
| BRK | 1.13 | 0.0476 | PTK6 | NM_005975 |
| OSM | 1.13 | 0.0344 | OSM | NM_020530 |
| SFRP2 | 1.12 | 0.0279 | SFRP2 | NM_003013 |
| MRP3 | 1.12 | 0.0946 | ABCC3 | NM_003786 |
| EGLN3 | 1.12 | 0.0452 | EGLN3 | NM_022073 |
| SIAT7B | 1.12 | 0.0603 | ST6GALNAC2 | NM_006456 |
| OPN, osteopontin | 1.12 | 0.0082 | SPP1 | NM_000582 |
| S100P | 1.12 | 0.0313 | S100P | NM_005980 |
| AKAP12 | 1.12 | 0.0865 | AKAP12 | NM_005100 |
| MMP7 | 1.11 | 0.0909 | MMP7 | NM_002423 |
| FABP4 | 1.11 | 0.0214 | FABP4 | NM_001442 |
| CRYAB | 1.11 | 0.0960 | CRYAB | NM_001885 |
| SFRP4 | 1.10 | 0.0625 | SFRP4 | NM_003014 |
| EFNA3 | 1.10 | 0.0707 | EFNA3 | NM_004952 |
| GSTT1 | 1.09 | 0.0516 | GSTT1 | NM_000853 |
| pS2 | 1.08 | 0.0313 | TFF1 | NM_003225 |
| REG4 | 1.08 | 0.0080 | REG4 | NM_032044 |
| IGFBP2 | 1.08 | 0.0846 | IGFBP2 | NM_000597 |
| MUC5B | 1.08 | 0.0387 | MUC5B | XM_039877 |

Table 3.2B shows associations between clinical outcome and gene expression for those genes which demonstrated a Hazard Ratio<1.0 and for which p<0.1. Univariate Cox Proportional Hazards Regression analysis was applied in combined Stage II (Duke's B) and Stage III (Duke's C) patients using DFS as the metric for clinical outcome.

| Gene | Hazard Ratio | P Value | Official Symbol | Accession Number |
|---|---|---|---|---|
| HSPA8 | 0.72 | 0.0604 | HSPA8 | NM_006597 |
| SLC25A3 | 0.73 | 0.0126 | SLC25A3 | NM_213611 |
| E2F1 | 0.73 | 0.0019 | E2F1 | NM_005225 |
| IFIT1 | 0.74 | 0.0820 | IFIT1 | NM_001548 |
| PPM1D | 0.74 | 0.0007 | PPM1D | NM_003620 |
| SKP2 | 0.75 | 0.0049 | SKP2 | NM_005983 |
| RRM1 | 0.78 | 0.0224 | RRM1 | NM_001033 |
| DDB1 | 0.79 | 0.0720 | DDB1 | NM_001923 |
| NPM1 | 0.79 | 0.0255 | NPM1 | NM_002520 |
| PRDX4 | 0.80 | 0.0570 | PRDX4 | NM_006406 |
| BRCA1 | 0.80 | 0.0064 | BRCA1 | NM_007295 |
| C20 orf1 | 0.81 | 0.0180 | TPX2 | NM_012112 |
| Chk1 | 0.81 | 0.0148 | CHEK1 | NM_001274 |
| EI24 | 0.81 | 0.0417 | EI24 | NM_004879 |
| CCNE2 | 0.81 | 0.0094 | CCNE2 | NM_057749 |
| HMGB1 | 0.82 | 0.0852 | HMGB1 | NM_002128 |
| SURV | 0.82 | 0.0185 | BIRC5 | NM_001168 |
| KIF22 | 0.82 | 0.0264 | KIF22 | NM_007317 |
| RAD54L | 0.82 | 0.0674 | RAD54L | NM_003579 |
| c-myb (MYB official) | 0.82 | 0.0038 | MYB | NM_005375 |
| DHFR | 0.82 | 0.0669 | DHFR | NM_000791 |
| TNFRSF5 | 0.83 | 0.0855 | CD40 | NM_001250 |
| LMNB1 | 0.83 | 0.0741 | LMNB1 | NM_005573 |
| CDC20 | 0.85 | 0.0538 | CDC20 | NM_001255 |
| CDCA7 v2 | 0.85 | 0.0277 | CDCA7 | NM_145810 |
| FASN | 0.85 | 0.0919 | FASN | NM_004104 |
| MCM2 | 0.85 | 0.0194 | MCM2 | NM_004526 |
| ABCB1 | 0.85 | 0.0169 | ABCB1 | NM_000927 |
| EIF4E | 0.85 | 0.0902 | EIF4E | NM_001968 |
| DUT | 0.86 | 0.0535 | DUT | NM_001948 |
| C20ORF126 | 0.86 | 0.0932 | PDRG1 | NM_030815 |
| MCM6 | 0.86 | 0.0970 | MCM6 | NM_005915 |
| EFP | 0.87 | 0.0850 | TRIM25 | NM_005082 |
| EPHB2 | 0.87 | 0.0314 | EPHB2 | NM_004442 |
| GCLC | 0.87 | 0.0862 | GCLC | NM_001498 |
| RCC1 | 0.87 | 0.0540 | RCC1 | NM_001269 |
| AREG | 0.87 | 0.0028 | AREG | NM_001657 |
| CMYC | 0.88 | 0.0584 | MYC | NM_002467 |
| MYBL2 | 0.88 | 0.0567 | MYBL2 | NM_002466 |
| TCF-1 | 0.88 | 0.0644 | TCF1 | NM_000545 |
| EREG | 0.89 | 0.0232 | EREG | NM_001432 |
| Cdx2 | 0.90 | 0.0354 | CDX2 | NM_001265 |
| PTPRO | 0.92 | 0.0935 | PTPRO | NM_030667 |
| cripto (TDGF1 official) | 0.92 | 0.0950 | TDGF1 | NM_003212 |
| HLA-DRB1 | 0.93 | 0.0521 | HLA-DRB1 | NM_002124 |

Table 4.2A shows associations between clinical outcome and gene expression for those genes which demonstrated a Hazard Ratio>1.0 and for which p<0.1. Univariate Cox Proportional Hazards Regression analysis was applied in combined Stage II (Duke's B) and Stage III (Duke's C) patients using DRFI as the metric for clinical outcome.

| Gene | Hazard Ratio | P Value | Official Symbol | Accession Number |
|---|---|---|---|---|
| ALDOA | 3.21 | 0.0189 | ALDOA | NM_000034 |
| DCK | 2.60 | 0.0248 | DCK | NM_000788 |
| ITGB1 | 2.58 | 0.0002 | ITGB1 | NM_002211 |
| COX2 | 2.16 | 0.0198 | PTGS2 | NM_000963 |
| TJP1 | 2.10 | 0.0122 | TJP1 | NM_003257 |
| STAT3 | 1.87 | 0.0148 | STAT3 | NM_003150 |
| ANXA5 | 1.83 | 0.0043 | ANXA5 | NM_001154 |
| GHI BRAF mut4 | 1.82 | 0.0024 | | GHI_BRAF_mut4 |
| TIMP1 | 1.80 | <.0001 | TIMP1 | NM_003254 |
| hMLH | 1.80 | 0.0242 | MLH1 | NM_000249 |
| PADI4 | 1.74 | 0.0288 | PADI4 | NM_012387 |
| rhoC | 1.74 | 0.0093 | RHOC | NM_175744 |
| CYP3A4 | 1.73 | 0.0219 | CYP3A4 | NM_017460 |
| WWOX | 1.72 | 0.0467 | WWOX | NM_016373 |
| ANXA2 | 1.70 | 0.0081 | ANXA2 | NM_004039 |
| LILRB3 | 1.70 | 0.0295 | LILRB3 | NM_006864 |
| VIM | 1.66 | 0.0015 | VIM | NM_003380 |
| FUS | 1.65 | 0.0432 | FUS | NM_004960 |
| KCNH2 iso a/b | 1.64 | 0.0111 | KCNH2 | NM_000238 |
| RhoB | 1.63 | 0.0019 | RHOB | NM_004040 |
| CRIP2 | 1.62 | 0.0455 | CRIP2 | NM_001312 |
| AKT3 | 1.60 | 0.0004 | AKT3 | NM_005465 |
| RBX1 | 1.60 | 0.0195 | RBX1 | NM_014248 |
| HB-EGF | 1.59 | 0.0032 | HBEGF | NM_001945 |
| NRP2 | 1.55 | 0.0007 | NRP2 | NM_003872 |
| MSH3 | 1.55 | 0.0353 | MSH3 | NM_002439 |
| PI3K | 1.54 | 0.0651 | PIK3C2B | NM_002646 |
| BGN | 1.54 | 0.0009 | BGN | NM_001711 |
| RAB6C | 1.54 | 0.0210 | RAB6C | NM_032144 |
| CTSB | 1.53 | 0.0415 | CTSB | NM_001908 |
| DLC1 | 1.53 | 0.0047 | DLC1 | NM_006094 |

-continued

| Gene | Hazard Ratio | P Value | Official Symbol | Accession Number |
|---|---|---|---|---|
| p21 | 1.53 | 0.0085 | CDKN1A | NM_000389 |
| CCNE2 variant 1 | 1.52 | 0.0647 | CCNE2 | NM_057749 |
| CALD1 | 1.51 | 0.0069 | CALD1 | NM_004342 |
| SBA2 | 1.51 | 0.0202 | WSB2 | NM_018639 |
| SIR2 | 1.51 | 0.0028 | SIRT1 | NM_012238 |
| ITGA5 | 1.50 | 0.0006 | ITGA5 | NM_002205 |
| RAP1GDS1 | 1.50 | 0.0317 | RAP1GDS1 | NM_021159 |
| CTHRC1 | 1.46 | 0.0010 | CTHRC1 | NM_138455 |
| STC1 | 1.46 | 0.0083 | STC1 | NM_003155 |
| KLF6 | 1.46 | 0.0362 | KLF6 | NM_001300 |
| CDC42BPA | 1.45 | 0.0187 | CDC42BPA | NM_003607 |
| CEBPB | 1.45 | 0.0605 | CEBPB | NM_005194 |
| LAMC2 | 1.45 | 0.0031 | LAMC2 | NM_005562 |
| TGFBR1 | 1.45 | 0.0824 | TGFBR1 | NM_004612 |
| TLN1 | 1.45 | 0.0730 | TLN1 | NM_006289 |
| CDC42 | 1.44 | 0.0387 | CDC42 | NM_001791 |
| FYN | 1.43 | 0.0070 | FYN | NM_002037 |
| IGFBP7 | 1.43 | 0.0283 | IGFBP7 | NM_001553 |
| ARG | 1.43 | 0.0119 | ABL2 | NM_005158 |
| HIF1A | 1.42 | 0.0397 | HIF1A | NM_001530 |
| FST | 1.42 | 0.0460 | FST | NM_006350 |
| S100A1 | 1.42 | 0.0473 | S100A1 | NM_006271 |
| FAP | 1.42 | 0.0023 | FAP | NM_004460 |
| DUSP1 | 1.42 | 0.0014 | DUSP1 | NM_004417 |
| EPAS1 | 1.41 | 0.0494 | EPAS1 | NM_001430 |
| Grb10 | 1.41 | 0.0027 | GRB10 | NM_005311 |
| VEGFC | 1.41 | 0.0894 | VEGFC | NM_005429 |
| INHBB | 1.41 | 0.0710 | INHBB | NM_002193 |
| GADD45B | 1.40 | 0.0023 | GADD45B | NM_015675 |
| UBC | 1.40 | 0.0368 | UBC | NM_021009 |
| GJA1 | 1.40 | 0.0053 | GJA1 | NM_000165 |
| COL1A2 | 1.40 | 0.0086 | COL1A2 | NM_000089 |
| RBM5 | 1.40 | 0.0423 | RBM5 | NM_005778 |
| ROCK1 | 1.39 | 0.0604 | ROCK1 | NM_005406 |
| CTGF | 1.39 | 0.0081 | CTGF | NM_001901 |
| FLT4 | 1.39 | 0.0978 | FLT4 | NM_002020 |
| PDGFC | 1.39 | 0.0052 | PDGFC | NM_016205 |
| INHBA | 1.39 | 0.0058 | INHBA | NM_002192 |
| LOXL2 | 1.38 | 0.0209 | LOXL2 | NM_002318 |
| THBS1 | 1.37 | 0.0090 | THBS1 | NM_003246 |
| ITGAV | 1.37 | 0.0298 | ITGAV | NM_002210 |
| NCAM1 | 1.36 | 0.0714 | NCAM1 | NM_000615 |
| PTHR1 | 1.35 | 0.0410 | PTHR1 | NM_000316 |
| TIMP2 | 1.35 | 0.0446 | TIMP2 | NM_003255 |
| LOX | 1.35 | 0.0041 | LOX | NM_002317 |
| SPARC | 1.35 | 0.0292 | SPARC | NM_003118 |
| TAGLN | 1.34 | 0.0222 | TAGLN | NM_003186 |
| CYR61 | 1.34 | 0.0086 | CYR61 | NM_001554 |
| RANBP9 | 1.34 | 0.0553 | RANBP9 | NM_005493 |
| GADD45 | 1.34 | 0.0604 | GADD45A | NM_001924 |
| S100A4 | 1.34 | 0.0141 | S100A4 | NM_002961 |
| SNAI2 | 1.33 | 0.0263 | SNAI2 | NM_003068 |
| EGR1 | 1.33 | 0.0174 | EGR1 | NM_001964 |
| CDH11 | 1.33 | 0.0355 | CDH11 | NM_001797 |
| SI | 1.33 | 0.0967 | SI | NM_001041 |
| PTK2 | 1.33 | 0.0911 | PTK2 | NM_005607 |
| MCP1 | 1.32 | 0.0215 | CCL2 | NM_002982 |
| PCAF | 1.32 | 0.0463 | PCAF | NM_003884 |
| c-abl | 1.32 | 0.0868 | ABL1 | NM_005157 |
| TIMP3 | 1.32 | 0.0455 | TIMP3 | NM_000362 |
| ANGPT2 | 1.31 | 0.0711 | ANGPT2 | NM_001147 |
| NOTCH2 | 1.30 | 0.0645 | NOTCH2 | NM_024408 |
| GBP2 | 1.30 | 0.0218 | GBP2 | NM_004120 |
| PAI1 | 1.30 | 0.0022 | SERPINE1 | NM_000602 |
| CXCR4 | 1.30 | 0.0341 | CXCR4 | NM_003467 |
| BCAS1 | 1.30 | 0.0060 | BCAS1 | NM_003657 |
| COL1A1 | 1.29 | 0.0349 | COL1A1 | NM_000088 |
| PIM1 | 1.29 | 0.0507 | PIM1 | NM_002648 |
| PDGFB | 1.29 | 0.0288 | PDGFB | NM_002608 |
| Bcl2 | 1.29 | 0.0270 | BCL2 | NM_000633 |
| SLPI | 1.29 | 0.0222 | SLPI | NM_003064 |
| IGFBP5 | 1.29 | 0.0676 | IGFBP5 | NM_000599 |
| ANXA1 | 1.29 | 0.0690 | ANXA1 | NM_000700 |
| FGFR1 | 1.28 | 0.0790 | FGFR1 | NM_023109 |
| CAPG | 1.28 | 0.0987 | CAPG | NM_001747 |
| PRKCA | 1.28 | 0.0548 | PRKCA | NM_002737 |

-continued

| Gene | Hazard Ratio | P Value | Official Symbol | Accession Number |
|---|---|---|---|---|
| EPHA2 | 1.28 | 0.0339 | EPHA2 | NM_004431 |
| AKAP12 | 1.28 | 0.0215 | AKAP12 | NM_005100 |
| FOS | 1.28 | 0.0219 | FOS | NM_005252 |
| CXCL12 | 1.27 | 0.0169 | CXCL12 | NM_000609 |
| GCNT1 | 1.27 | 0.0875 | GCNT1 | NM_001490 |
| IGFBP3 | 1.27 | 0.0499 | IGFBP3 | NM_000598 |
| DPYD | 1.27 | 0.0259 | DPYD | NM_000110 |
| CD68 | 1.27 | 0.0752 | CD68 | NM_001251 |
| EFNA1 | 1.27 | 0.0890 | EFNA1 | NM_004428 |
| ABCC5 | 1.26 | 0.0536 | ABCC5 | NM_005688 |
| TUBB | 1.26 | 0.0635 | TUBB2 | NM_001069 |
| PDGFA | 1.26 | 0.0676 |  | NM_002607 |
| DAPK1 | 1.26 | 0.0701 | DAPK1 | NM_004938 |
| SFRP2 | 1.25 | 0.0109 | SFRP2 | NM_003013 |
| ID3 | 1.25 | 0.0744 | ID3 | NM_002167 |
| CTSL | 1.25 | 0.0679 | CTSL | NM_001912 |
| LAMA3 | 1.25 | 0.0299 | LAMA3 | NM_000227 |
| KRT19 | 1.25 | 0.0982 | KRT19 | NM_002276 |
| S100A8 | 1.25 | 0.0228 | S100A8 | NM_002964 |
| IL6 | 1.25 | 0.0933 | IL6 | NM_000600 |
| MRP3 | 1.25 | 0.0538 | ABCC3 | NM_003786 |
| FES | 1.25 | 0.0694 | FES | NM_002005 |
| AP-1 (JUN official) | 1.25 | 0.0974 | JUN | NM_002228 |
| WISP1 | 1.24 | 0.0897 | WISP1 | NM_003882 |
| SFRP4 | 1.24 | 0.0250 | SFRP4 | NM_003014 |
| TGFBI | 1.24 | 0.0692 | TGFBI | NM_000358 |
| Maspin | 1.24 | 0.0152 | SERPINB5 | NM_002639 |
| HOXB7 | 1.23 | 0.0541 | HOXB7 | NM_004502 |
| P14ARF | 1.23 | 0.0944 |  | S78535 |
| HSPA1A | 1.23 | 0.0259 | HSPA1A | NM_005345 |
| EGR3 | 1.22 | 0.0312 | EGR3 | NM_004430 |
| CRYAB | 1.22 | 0.0483 | CRYAB | NM_001885 |
| ALDH1A1 | 1.22 | 0.0372 | ALDH1A1 | NM_000689 |
| TGFB3 | 1.22 | 0.0673 | TGFB3 | NM_003239 |
| KLK6 | 1.21 | 0.0288 | KLK6 | NM_002774 |
| ANTXR1 | 1.21 | 0.0942 | ANTXR1 | NM_032208 |
| FZD6 | 1.20 | 0.0479 | FZD6 | NM_003506 |
| ILT-2 | 1.20 | 0.0930 | LILRB1 | NM_006669 |
| S100A2 | 1.20 | 0.0116 | S100A2 | NM_005978 |
| MMP7 | 1.18 | 0.0987 | MMP7 | NM_002423 |
| FABP4 | 1.17 | 0.0371 | FABP4 | NM_001442 |
| OPN, osteopontin | 1.17 | 0.0301 | SPP1 | NM_000582 |
| KLK10 | 1.16 | 0.0581 | KLK10 | NM_002776 |
| pS2 | 1.15 | 0.0186 | TEF1 | NM_003225 |
| REG4 | 1.14 | 0.0053 | REG4 | NM_032044 |
| MUC2 | 1.09 | 0.0429 | MUC2 | NM_002457 |

Table 4.2B shows associations between clinical outcome and gene expression for those genes which demonstrated a Hazard Ratio<1.0 and for which p<0.1. Univariate Cox Proportional Hazards Regression analysis was applied in combined Stage II (Duke's B) and Stage III (Duke's C) patients using DRFI as the metric for clinical outcome.

| Gene | Hazard Ratio | P Value | Official Symbol | Accession Number |
|---|---|---|---|---|
| HSPA8 | 0.48 | 0.0114 | HSPA8 | NM_006597 |
| RPS13 | 0.64 | 0.0082 | RPS13 | NM_001017 |
| NDUFS3 | 0.66 | 0.0096 | NDUFS3 | NM_004551 |
| ST14 | 0.66 | 0.0132 | ST14 | NM_021978 |
| LMNB1 | 0.66 | 0.0135 | LMNB1 | NM_005573 |
| TMSB4X | 0.67 | 0.0039 | TMSB4X | NM_021109 |
| DHFR | 0.68 | 0.0260 | DHFR | NM_000791 |
| BRCA1 | 0.68 | 0.0029 | BRCA1 | NM_007295 |
| SKP2 | 0.68 | 0.0151 | SKP2 | NM_005983 |
| SLC25A3 | 0.69 | 0.0265 | SLC25A3 | NM_213611 |
| CDC20 | 0.69 | 0.0048 | CDC20 | NM_001255 |
| RPLPO | 0.70 | 0.0320 | RPLP0 | NM_001002 |
| TCF-1 | 0.70 | 0.0013 | TCF1 | NM_000545 |

-continued

| Gene | Hazard Ratio | P Value | Official Symbol | Accession Number |
|---|---|---|---|---|
| RRM1 | 0.71 | 0.0598 | RRM1 | NM_001033 |
| ATP5A1 | 0.71 | 0.0827 | ATP5A1 | NM_004046 |
| NME1 | 0.73 | 0.0378 | NME1 | NM_000269 |
| CKS2 | 0.74 | 0.0537 | CKS2 | NM_001827 |
| EI24 | 0.74 | 0.0639 | EI24 | NM_004879 |
| C20 orf1 | 0.74 | 0.0435 | TPX2 | NM_012112 |
| SDC1 | 0.74 | 0.0930 | SDC1 | NM_002997 |
| CSEL1 | 0.75 | 0.0443 | CSE1L | NM_001316 |
| ABCC6 | 0.76 | 0.0416 | ABCC6 | NM_001171 |
| MCM2 | 0.76 | 0.0136 | MCM2 | NM_004526 |
| NFKBp65 | 0.77 | 0.0672 | RELA | NM_021975 |
| EPHB2 | 0.77 | 0.0133 | EPHB2 | NM_004442 |
| FASN | 0.78 | 0.0980 | FASN | NM_004104 |
| AURKB | 0.78 | 0.0528 | AURKB | NM_004217 |
| VDR | 0.79 | 0.0832 | VDR | NM_000376 |
| UMPS | 0.80 | 0.0721 | UMPS | NM_000373 |
| UBE2C | 0.81 | 0.0860 | UBE2C | NM_007019 |
| CMYC | 0.82 | 0.0742 | MYC | NM_002467 |
| MYBL2 | 0.83 | 0.0780 | MYBL2 | NM_002466 |
| Cdx2 | 0.84 | 0.0392 | CDX2 | NM_001265 |
| MX1 | 0.85 | 0.0786 | MX1 | NM_002462 |
| EREG | 0.85 | 0.0638 | EREG | NM_001432 |
| AREG | 0.85 | 0.0295 | AREG | NM_001657 |

Table 5.2A shows associations between gene expression and RFI, controlling for particular demographic and clinical characteristics of patients included in the analysis. All genes are listed whose expression correlates with RFI (p<0.1) and which demonstrated a Hazard Ratio>1 in a multivariate analysis including the following variables: tumor location, year of surgery, tumor grade, treatment protocol (C-01 or C-02), BCG treatment (yes or no), and classification of patients according to lymph node status as follows: 0 positive nodes and <12 nodes examined, 0 positive nodes and ≧12 nodes examined, 1-3 positive nodes, and ≧4 positive nodes.

| Gene | Hazard Ratio | LR Chi-Square | DF | P Value | Official Symbol | Accession Number |
|---|---|---|---|---|---|---|
| RARB | 2.02 | 3.42 | 1 | 0.0644 | RARB | NM_016152 |
| COX2 | 1.69 | 3.13 | 1 | 0.0768 | PTGS2 | NM_000963 |
| RhoC | 1.60 | 8.71 | 1 | 0.0032 | RHOC | NM_175744 |
| CYP3A4 | 1.57 | 5.15 | 1 | 0.0233 | CYP3A4 | NM_017460 |
| RhoB | 1.54 | 12.40 | 1 | 0.0004 | RHOB | NM_004040 |
| ANXA2 | 1.54 | 7.01 | 1 | 0.0081 | ANXA2 | NM_004039 |
| ITGB1 | 1.54 | 5.54 | 1 | 0.0186 | ITGB1 | NM_002211 |
| NTN1 | 1.53 | 3.63 | 1 | 0.0568 | NTN1 | NM_004822 |
| KRAS2 | 1.51 | 4.83 | 1 | 0.0279 | KRAS | NM_004985 |
| IGFBP7 | 1.44 | 8.53 | 1 | 0.0035 | IGFBP7 | NM_001553 |
| TIMP1 | 1.43 | 9.03 | 1 | 0.0027 | TIMP1 | NM_003254 |
| WWOX | 1.43 | 2.73 | 1 | 0.0988 | WWOX | NM_016373 |
| CYP1B1 | 1.39 | 3.69 | 1 | 0.0548 | CYP1B1 | NM_000104 |
| KCNH2 iso a/b | 1.38 | 3.23 | 1 | 0.0723 | KCNH2 | NM_000238 |
| STC1 | 1.37 | 6.55 | 1 | 0.0105 | STC1 | NM_003155 |
| ITGAV | 1.37 | 9.37 | 1 | 0.0022 | ITGAV | NM_002210 |
| VEGFC | 1.37 | 3.62 | 1 | 0.0571 | VEGFC | NM_005429 |
| G-Catenin | 1.36 | 4.78 | 1 | 0.0287 | JUP | NM_002230 |
| S100A1 | 1.34 | 4.12 | 1 | 0.0423 | S100A1 | NM_006271 |
| GADD45B | 1.34 | 9.63 | 1 | 0.0019 | GADD45B | NM_015675 |
| NCAM1 | 1.33 | 3.00 | 1 | 0.0832 | NCAM1 | NM_000615 |
| CALD1 | 1.33 | 6.05 | 1 | 0.0139 | CALD1 | NM_004342 |
| FST | 1.33 | 4.24 | 1 | 0.0396 | FST | NM_006350 |
| INHBA | 1.33 | 9.68 | 1 | 0.0019 | INHBA | NM_002192 |
| BGN | 1.33 | 7.27 | 1 | 0.0070 | BGN | NM_001711 |
| Claudin 4 | 1.33 | 7.13 | 1 | 0.0076 | CLDN4 | NM_001305 |
| CEBPB | 1.33 | 2.96 | 1 | 0.0851 | CEBPB | NM_005194 |
| LAMC2 | 1.32 | 8.62 | 1 | 0.0033 | LAMC2 | NM_005562 |
| SPINT2 | 1.32 | 3.14 | 1 | 0.0762 | SPINT2 | NM_021102 |
| AKT3 | 1.32 | 7.54 | 1 | 0.0060 | AKT3 | NM_005465 |
| TIMP3 | 1.32 | 6.33 | 1 | 0.0119 | TIMP3 | NM_000362 |
| MAPK14 | 1.31 | 2.75 | 1 | 0.0972 | MAPK14 | NM_139012 |
| HB-EGF | 1.31 | 4.74 | 1 | 0.0294 | HBEGF | NM_001945 |
| DUSP1 | 1.30 | 11.34 | 1 | 0.0008 | DUSP1 | NM_004417 |
| EFNA1 | 1.30 | 5.87 | 1 | 0.0154 | EFNA1 | NM_004428 |
| PTK2 | 1.29 | 3.60 | 1 | 0.0576 | PTK2 | NM_005607 |
| DLC1 | 1.29 | 5.19 | 1 | 0.0227 | DLC1 | NM_006094 |
| EPAS1 | 1.28 | 3.30 | 1 | 0.0693 | EPAS1 | NM_001430 |
| THBS1 | 1.28 | 7.51 | 1 | 0.0061 | THBS1 | NM_003246 |
| TIMP2 | 1.28 | 4.20 | 1 | 0.0404 | TIMP2 | NM_003255 |
| TGFBI | 1.27 | 6.68 | 1 | 0.0098 | TGFBI | NM_000358 |
| DKK1 | 1.27 | 3.05 | 1 | 0.0806 | DKK1 | NM_012242 |
| SPARC | 1.26 | 4.37 | 1 | 0.0366 | SPARC | NM_003118 |
| PDGFC | 1.26 | 6.74 | 1 | 0.0094 | PDGFC | NM_016205 |
| RAB6C | 1.26 | 3.27 | 1 | 0.0704 | RAB6C | NM_032144 |
| LOXL2 | 1.26 | 4.48 | 1 | 0.0343 | LOXL2 | NM_002318 |
| CD68 | 1.25 | 4.68 | 1 | 0.0305 | CD68 | NM_001251 |
| LOX | 1.25 | 7.16 | 1 | 0.0075 | LOX | NM_002317 |
| CDC42BPA | 1.25 | 3.35 | 1 | 0.0671 | CDC42BPA | NM_003607 |

-continued

| Gene | Hazard Ratio | LR Chi-Square | DF | P Value | Official Symbol | Accession Number |
|---|---|---|---|---|---|---|
| TAGLN | 1.25 | 4.83 | 1 | 0.0279 | TAGLN | NM_003186 |
| CTHRC1 | 1.25 | 5.96 | 1 | 0.0146 | CTHRC1 | NM_138455 |
| PDGFA | 1.25 | 4.63 | 1 | 0.0314 | | NM_002607 |
| TMEPAI | 1.24 | 5.63 | 1 | 0.0176 | TMEPAI | NM_020182 |
| RAB32 | 1.24 | 4.48 | 1 | 0.0343 | RAB32 | NM_006834 |
| HSPA1A | 1.24 | 8.19 | 1 | 0.0042 | HSPA1A | NM_005345 |
| VIM | 1.24 | 2.97 | 1 | 0.0848 | VIM | NM_003380 |
| IGFBP5 | 1.23 | 3.69 | 1 | 0.0549 | IGFBP5 | NM_000599 |
| EGR1 | 1.23 | 5.12 | 1 | 0.0236 | EGR1 | NM_001964 |
| ANGPT2 | 1.23 | 2.96 | 1 | 0.0852 | ANGPT2 | NM_001147 |
| NDRG1 | 1.22 | 2.91 | 1 | 0.0879 | NDRG1 | NM_006096 |
| VEGF_altsplice1 | 1.22 | 4.08 | 1 | 0.0433 | | AF486837 |
| SLPI | 1.22 | 4.94 | 1 | 0.0262 | SLPI | NM_003064 |
| FOS | 1.22 | 5.67 | 1 | 0.0172 | FOS | NM_005252 |
| VEGF | 1.22 | 2.80 | 1 | 0.0942 | VEGF | NM_003376 |
| ADAMTS12 | 1.22 | 4.40 | 1 | 0.0359 | ADAMTS12 | NM_030955 |
| Maspin | 1.22 | 7.60 | 1 | 0.0058 | SERPINB5 | NM_002639 |
| CGB | 1.22 | 3.25 | 1 | 0.0713 | CGB | NM_000737 |
| CYR61 | 1.21 | 5.22 | 1 | 0.0224 | CYR61 | NM_001554 |
| GJB2 | 1.21 | 3.77 | 1 | 0.0522 | GJB2 | NM_004004 |
| IGFBP3 | 1.21 | 4.24 | 1 | 0.0396 | IGFBP3 | NM_000598 |
| PRKCA | 1.21 | 3.81 | 1 | 0.0508 | PRKCA | NM_002737 |
| S100P | 1.21 | 6.98 | 1 | 0.0082 | S100P | NM_005980 |
| NRP2 | 1.21 | 3.25 | 1 | 0.0714 | NRP2 | NM_003872 |
| EFNB2 | 1.21 | 3.00 | 1 | 0.0834 | EFNB2 | NM_004093 |
| COL1A2 | 1.21 | 3.59 | 1 | 0.0581 | COL1A2 | NM_000089 |
| VEGFB | 1.20 | 2.80 | 1 | 0.0942 | VEGFB | NM_003377 |
| HOXB7 | 1.20 | 4.37 | 1 | 0.0367 | HOXB7 | NM_004502 |
| Grb10 | 1.20 | 3.91 | 1 | 0.0480 | GRB10 | NM_005311 |
| FAP | 1.20 | 4.12 | 1 | 0.0425 | FAP | NM_004460 |
| GJA1 | 1.20 | 4.80 | 1 | 0.0285 | GJA1 | NM_000165 |
| CTGF | 1.19 | 3.38 | 1 | 0.0660 | CTGF | NM_001901 |
| NR4A1 | 1.18 | 5.13 | 1 | 0.0235 | NR4A1 | NM_002135 |
| COL1A1 | 1.18 | 2.77 | 1 | 0.0961 | COL1A1 | NM_000088 |
| ABCC5 | 1.17 | 2.80 | 1 | 0.0945 | ABCC5 | NM_005688 |
| EMP1 | 1.17 | 3.06 | 1 | 0.0804 | EMP1 | NM_001423 |
| SFRP2 | 1.17 | 4.89 | 1 | 0.0270 | SFRP2 | NM_003013 |
| SLC2A1 | 1.17 | 3.52 | 1 | 0.0606 | SLC2A1 | NM_006516 |
| F3 | 1.17 | 3.10 | 1 | 0.0783 | F3 | NM_001993 |
| S100A4 | 1.17 | 2.87 | 1 | 0.0900 | S100A4 | NM_002961 |
| BRK | 1.17 | 2.81 | 1 | 0.0935 | PTK6 | NM_005975 |
| CRYAB | 1.17 | 3.77 | 1 | 0.0523 | CRYAB | NM_001885 |
| MDK | 1.16 | 3.84 | 1 | 0.0500 | MDK | NM_002391 |
| OPN, osteopontin | 1.16 | 6.07 | 1 | 0.0138 | SPP1 | NM_000582 |
| SFRP4 | 1.16 | 4.09 | 1 | 0.0432 | SFRP4 | NM_003014 |
| SIAT4A | 1.16 | 2.76 | 1 | 0.0969 | ST3GAL1 | NM_003033 |
| LAMA3 | 1.16 | 3.23 | 1 | 0.0725 | LAMA3 | NM_000227 |
| AKAP12 | 1.15 | 2.74 | 1 | 0.0976 | AKAP12 | NM_005100 |
| KLK10 | 1.15 | 5.23 | 1 | 0.0221 | KLK10 | NM_002776 |
| EGR3 | 1.14 | 3.16 | 1 | 0.0755 | EGR3 | NM_004430 |
| PAI1 | 1.13 | 3.39 | 1 | 0.0655 | SERPINE1 | NM_000602 |
| CEACAM6 | 1.13 | 2.98 | 1 | 0.0845 | CEACAM6 | NM_002483 |
| KLK6 | 1.13 | 3.74 | 1 | 0.0532 | KLK6 | NM_002774 |
| Nkd-1 | 1.11 | 3.34 | 1 | 0.0674 | NKD1 | NM_033119 |
| IGFBP2 | 1.11 | 3.15 | 1 | 0.0758 | IGFBP2 | NM_000597 |
| REG4 | 1.08 | 3.51 | 1 | 0.0610 | REG4 | NM_032044 |

Table 5.2B shows associations between gene expression and RFI, controlling for particular demographic and clinical characteristics of patients included in the analysis. All genes are listed whose expression correlates with RFI (p<0.1) and which demonstrated a Hazard Ratio<1 in a multivariate analysis including the following variables: tumor location, year of surgery, tumor grade, treatment protocol (C-01 or C-02), BCG treatment (yes or no), and classification of patients according to lymph node status as follows: 0 positive nodes and <12 nodes examined, 0 positive nodes and ≧12 nodes examined, 1-3 positive nodes, and ≧4 positive nodes.

| Gene | Hazard Ratio | LR Chi-Square | DF | P Value | Official Symbol | Accession Number |
|---|---|---|---|---|---|---|
| Fasl | 0.43 | 5.57 | 1 | 0.0183 | FASLG | NM_000639 |
| BFGF | 0.57 | 4.68 | 1 | 0.0306 | NUDT6 | NM_007083 |

-continued

| Gene | Hazard Ratio | LR Chi-Square | DF | P Value | Official Symbol | Accession Number |
|---|---|---|---|---|---|---|
| EstR1 | 0.57 | 3.22 | 1 | 0.0726 | ESR1 | NM_000125 |
| IFIT1 | 0.60 | 4.30 | 1 | 0.0381 | IFIT1 | NM_001548 |
| KLRK1 | 0.64 | 10.81 | 1 | 0.0010 | KLRK1 | NM_007360 |
| E2F1 | 0.65 | 7.49 | 1 | 0.0062 | E2F1 | NM_005225 |
| BRCA1 | 0.66 | 16.33 | 1 | <.0001 | BRCA1 | NM_007295 |
| RAD54L | 0.67 | 6.36 | 1 | 0.0117 | RAD54L | NM_003579 |
| ATP5A1 | 0.67 | 5.50 | 1 | 0.0190 | ATP5A1 | NM_004046 |
| MCM3 | 0.68 | 2.84 | 1 | 0.0922 | MCM3 | NM_002388 |
| DHFR | 0.68 | 7.44 | 1 | 0.0064 | DHFR | NM_000791 |
| HSPA8 | 0.68 | 2.96 | 1 | 0.0855 | HSPA8 | NM_006597 |
| APG-1 | 0.71 | 5.86 | 1 | 0.0155 | HSPA4L | NM_014278 |
| BRCA2 | 0.71 | 4.69 | 1 | 0.0304 | BRCA2 | NM_000059 |
| TRAIL | 0.71 | 7.27 | 1 | 0.0070 | TNFSF10 | NM_003810 |
| SLC25A3 | 0.71 | 5.56 | 1 | 0.0184 | SLC25A3 | NM_213611 |
| PPM1D | 0.72 | 8.02 | 1 | 0.0046 | PPM1D | NM_003620 |
| Chk1 | 0.73 | 6.61 | 1 | 0.0102 | CHEK1 | NM_001274 |
| CD80 | 0.73 | 6.85 | 1 | 0.0089 | CD80 | NM_005191 |
| MADH2 | 0.73 | 3.93 | 1 | 0.0476 | SMAD2 | NM_005901 |
| KIF22 | 0.75 | 5.77 | 1 | 0.0163 | KIF22 | NM_007317 |
| TNFRSF5 | 0.76 | 3.52 | 1 | 0.0607 | CD40 | NM_001250 |
| C20 orf1 | 0.76 | 4.82 | 1 | 0.0281 | TPX2 | NM_012112 |
| ENO1 | 0.76 | 2.88 | 1 | 0.0894 | ENO1 | NM_001428 |
| PRKCB1 | 0.77 | 4.25 | 1 | 0.0393 | PRKCB1 | NM_002738 |
| RAF1 | 0.77 | 4.17 | 1 | 0.0412 | RAF1 | NM_002880 |
| RRM1 | 0.78 | 3.07 | 1 | 0.0799 | RRM1 | NM_001033 |
| UBE2M | 0.78 | 4.43 | 1 | 0.0352 | UBE2M | NM_003969 |
| SKP2 | 0.79 | 3.42 | 1 | 0.0644 | SKP2 | NM_005983 |
| DUT | 0.79 | 4.38 | 1 | 0.0364 | DUT | NM_001948 |
| EI24 | 0.80 | 2.85 | 1 | 0.0912 | EI24 | NM_004879 |
| UMPS | 0.80 | 4.96 | 1 | 0.0260 | UMPS | NM_000373 |
| EFP | 0.81 | 3.83 | 1 | 0.0502 | TRIM25 | NM_005082 |
| HRAS | 0.81 | 3.80 | 1 | 0.0513 | HRAS | NM_005343 |
| CDC20 | 0.81 | 3.78 | 1 | 0.0519 | CDC20 | NM_001255 |
| CSF1 | 0.82 | 2.86 | 1 | 0.0910 | CSF1 | NM_000757 |
| CKS2 | 0.82 | 2.90 | 1 | 0.0886 | CKS2 | NM_001827 |
| ABCB1 | 0.82 | 4.02 | 1 | 0.0450 | ABCB1 | NM_000927 |
| CDC6 | 0.83 | 4.23 | 1 | 0.0397 | CDC6 | NM_001254 |
| GBP1 | 0.83 | 4.34 | 1 | 0.0373 | GBP1 | NM_002053 |
| SURV | 0.83 | 2.91 | 1 | 0.0878 | BIRC5 | NM_001168 |
| CCNE2 | 0.83 | 2.75 | 1 | 0.0975 | CCNE2 | NM_057749 |
| RRM2 | 0.83 | 4.19 | 1 | 0.0407 | RRM2 | NM_001034 |
| CMYC | 0.84 | 3.34 | 1 | 0.0677 | MYC | NM_002467 |
| TCF-1 | 0.84 | 3.96 | 1 | 0.0466 | TCF1 | NM_000545 |
| c-myb (MYB official) | 0.84 | 3.72 | 1 | 0.0538 | MYB | NM_005375 |
| NOTCH1 | 0.85 | 3.39 | 1 | 0.0658 | NOTCH1 | NM_017617 |
| MCM2 | 0.85 | 3.30 | 1 | 0.0693 | MCM2 | NM_004526 |
| ING5 | 0.85 | 2.84 | 1 | 0.0922 | ING5 | NM_032329 |
| AREG | 0.88 | 3.72 | 1 | 0.0538 | AREG | NM_001657 |
| HLA-DRB1 | 0.90 | 3.84 | 1 | 0.0500 | HLA-DRB1 | NM_002124 |

Table 6.2 shows associations between gene expression and clinical outcome based on a nonlinear proportional hazards analysis, using a 2 degree-of-freedom natural spline. All genes are listed which demonstrated a departure from a strictly linear relationship (p<0.05) with RFI in combined Stage II (Duke's B) and Stage III (Duke's C) patients. The relationship between gene expression and RFI was not constant throughout the observed range of expression values in the study, e.g. increases in gene expression may have been related to increases in duration of RFI in one portion of the observed range and with decreases in duration of RFI in a different portion of the range.

| Gene | P Value | Official Symbol | Accession Number |
|---|---|---|---|
| PTHLH | <.0001 | PTHLH | NM_002820 |
| TGFBR1 | 0.0011 | TGFBR1 | NM_004612 |
| CDCA7 v2 | 0.0020 | CDCA7 | NM_145810 |
| S100A4 | 0.0034 | S100A4 | NM_002961 |
| CREBBP | 0.0040 | CREBBP | NM_004380 |
| Upa | 0.0040 | PLAU | NM_002658 |
| KLF5 | 0.0048 | KLF5 | NM_001730 |
| CYP2C8 | 0.0070 | CYP2C8 | NM_000770 |
| HES6 | 0.0090 | HES6 | NM_018645 |
| Cad17 | 0.0093 | CDH17 | NM_004063 |
| CEGP1 | 0.0100 | SCUBE2 | NM_020974 |
| GHI k-ras mut3 | 0.0100 | | GHI_k-ras_mut3 |
| AKT1 | 0.0104 | AKT1 | NM_005163 |
| LAMB3 | 0.0111 | LAMB3 | NM_000228 |
| CAPG | 0.0120 | CAPG | NM_001747 |
| FUT6 | 0.0130 | FUT6 | NM_000150 |
| A-Catenin | 0.0141 | CTNNA1 | NM_001903 |
| CAPN1 | 0.0167 | CAPN1 | NM_005186 |
| HSPE1 | 0.0180 | HSPE1 | NM_002157 |

-continued

| Gene | P Value | Official Symbol | Accession Number |
|---|---|---|---|
| MADH4 | 0.0180 | SMAD4 | NM_005359 |
| STMY3 | 0.0190 | MMP11 | NM_005940 |
| TRAG3 | 0.0200 | CSAG2 | NM_004909 |
| GBP1 | 0.0200 | GBP1 | NM_002053 |
| EFNA1 | 0.0210 | EFNA1 | NM_004428 |
| SEMA3B | 0.0210 | SEMA3B | NM_004636 |
| CLTC | 0.0216 | CLTC | NM_004859 |
| BRK | 0.0240 | PTK6 | NM_005975 |
| Fas | 0.0240 | FAS | NM_000043 |
| CCNE2 variant 1 | 0.0243 | CCNE2 | NM_057749 |
| TMEPAI | 0.0246 | TMEPAI | NM_020182 |
| PTPRJ | 0.0260 | PTPRJ | NM_002843 |
| SKP2 | 0.0261 | SKP2 | NM_005983 |
| AGXT | 0.0273 | AGXT | NM_000030 |
| MAP2 | 0.0320 | MAP2 | NM_031846 |
| PFN2 | 0.0330 | PFN2 | NM_053024 |
| ATP5E | 0.0350 | ATP5E | NM_006886 |
| NRP1 | 0.0352 | NRP1 | NM_003873 |
| MYH11 | 0.0360 | MYH11 | NM_002474 |
| cIAP2 | 0.0369 | BIRC3 | NM_001165 |
| INHBA | 0.0370 | INHBA | NM_002192 |
| EGLN1 | 0.0371 | EGLN1 | NM_022051 |
| GRIK1 | 0.0380 | GRIK1 | NM_000830 |
| KDR | 0.0380 | KDR | NM_002253 |
| KLK6 | 0.0388 | KLK6 | NM_002774 |
| APOC1 | 0.0390 | APOC1 | NM_001645 |
| EP300 | 0.0390 | EP300 | NM_001429 |
| DET1 | 0.0390 | DET1 | NM_017996 |
| ITGB4 | 0.0394 | ITGB4 | NM_000213 |
| CD3z | 0.0400 | CD3Z | NM_000734 |
| MAX | 0.0400 | MAX | NM_002382 |
| PAI1 | 0.0407 | SERPINE1 | NM_000602 |
| MADH7 | 0.0430 | SMAD7 | NM_005904 |
| SIR2 | 0.0440 | SIRT1 | NM_012238 |
| NEDD8 | 0.0440 | NEDD8 | NM_006156 |
| EPHB2 | 0.0445 | EPHB2 | NM_004442 |
| BTF3 | 0.0460 | BTF3 | NM_001207 |
| CD34 | 0.0470 | CD34 | NM_001773 |
| VEGF_altsplice2 | 0.0480 | | AF214570 |
| Wnt-5b | 0.0480 | WNT5B | NM_032642 |
| RXRA | 0.0482 | RXRA | NM_002957 |
| tusc4 | 0.0486 | TUSC4 | NM_006545 |

Table 7.2 shows all genes exhibiting an interaction (p-value<0.1) with tumor stage. The data were modeled using a proportional hazards model of RFI with gene expression, tumor stage, and their interaction as predictors. Patients who had 0 positive nodes but <12 nodes examined were excluded from these analyses.

| Gene | HR Stage II | HR Stage III | P-Value for Interaction | Official Symbol | Accession Number |
|---|---|---|---|---|---|
| SOS1 | 3.35 | 0.81 | 0.0009 | SOS1 | NM_005633 |
| ALCAM | 2.36 | 0.94 | 0.0020 | ALCAM | NM_001627 |

-continued

| Gene | HR Stage II | HR Stage III | P-Value for Interaction | Official Symbol | Accession Number |
|---|---|---|---|---|---|
| pS2 | 1.58 | 1.04 | 0.0040 | TFF1 | NM_003225 |
| TGFB2 | 1.83 | 0.95 | 0.0064 | TGFB2 | NM_003238 |
| TFF3 | 1.57 | 0.90 | 0.0066 | TFF3 | NM_003226 |
| KLF6 | 0.35 | 1.34 | 0.0092 | KLF6 | NM_001300 |
| SNRPF | 0.50 | 1.16 | 0.0106 | SNRPF | NM_003095 |
| CENPA | 2.41 | 0.94 | 0.0106 | CENPA | NM_001809 |
| HES6 | 1.69 | 0.86 | 0.0119 | HES6 | NM_018645 |
| CLDN1 | 0.51 | 0.95 | 0.0124 | CLDN1 | NM_021101 |
| FGF2 | 0.19 | 0.97 | 0.0125 | FGF2 | NM_002006 |
| LEF | 1.94 | 0.94 | 0.0141 | LEF1 | NM_016269 |
| MADH2 | 2.70 | 0.74 | 0.0145 | SMAD2 | NM_005901 |
| TP53BP1 | 2.31 | 0.91 | 0.0153 | TP53BP1 | NM_005657 |
| CCR7 | 1.89 | 0.98 | 0.0182 | CCR7 | NM_001838 |
| MRP3 | 2.26 | 1.08 | 0.0204 | ABCC3 | NM_003786 |
| UPP1 | 0.16 | 1.02 | 0.0208 | UPP1 | NM_003364 |
| PTEN | 3.46 | 1.00 | 0.0216 | PTEN | NM_000314 |
| ST14 | 1.64 | 0.66 | 0.0223 | ST14 | NM_021978 |
| FYN | 2.28 | 1.10 | 0.0241 | FYN | NM_002037 |
| CD24 | 1.33 | 0.84 | 0.0260 | CD24 | NM_013230 |
| LMYC | 1.80 | 0.82 | 0.0275 | RLF | NM_012421 |
| CDC42BPA | 2.82 | 1.12 | 0.0315 | CDC42BPA | NM_003607 |
| CAV1 | 2.11 | 0.95 | 0.0364 | CAV1 | NM_001753 |
| CHFR | 1.81 | 0.99 | 0.0382 | CHFR | NM_018223 |
| MGAT5 | 1.59 | 0.72 | 0.0383 | MGAT5 | NM_002410 |
| FPGS | 1.93 | 0.71 | 0.0402 | FPGS | NM_004957 |
| EMR3 | 2.63 | 0.57 | 0.0488 | EMR3 | NM_032571 |
| SIR2 | 2.17 | 1.07 | 0.0538 | SIRT1 | NM_012238 |
| PTK2B | 1.44 | 0.93 | 0.0542 | PTK2B | NM_004103 |
| Axin 2 | 1.38 | 0.90 | 0.0549 | AXIN2 | NM_004655 |
| TRAG3 | 0.46 | 1.12 | 0.0570 | CSAG2 | NM_004909 |
| MMP7 | 0.78 | 1.28 | 0.0608 | MMP7 | NM_002423 |
| PFN2 | 1.33 | 0.84 | 0.0610 | PFN2 | NM_053024 |
| PTPRJ | 2.05 | 1.00 | 0.0632 | PTPRJ | NM_002843 |
| CXCR4 | 1.96 | 1.08 | 0.0644 | CXCR4 | NM_003467 |
| CCNA2 | 1.55 | 0.79 | 0.0661 | CCNA2 | NM_001237 |
| MMP12 | 0.74 | 1.11 | 0.0685 | MMP12 | NM_002426 |
| KRT8 | 0.64 | 1.27 | 0.0694 | KRT8 | NM_002273 |
| ABCC5 | 2.06 | 1.14 | 0.0704 | ABCC5 | NM_005688 |
| PRDX6 | 2.09 | 0.74 | 0.0711 | PRDX6 | NM_004905 |
| WIF | 1.54 | 0.77 | 0.0738 | WIF1 | NM_007191 |
| cdc25A | 2.48 | 0.94 | 0.0769 | CDC25A | NM_001789 |
| KLF5 | 1.87 | 1.03 | 0.0772 | KLF5 | NM_001730 |
| LRP5 | 1.92 | 0.98 | 0.0783 | LRP5 | NM_002335 |
| PTPD1 | 0.54 | 1.00 | 0.0789 | PTPN21 | NM_007039 |
| RALBP1 | 2.20 | 0.91 | 0.0791 | RALBP1 | NM_006788 |
| TP53BP2 | 1.82 | 1.05 | 0.0819 | TP53BP2 | NM_005426 |
| STAT5B | 1.57 | 0.86 | 0.0822 | STAT5B | NM_012448 |
| PPARG | 1.32 | 0.79 | 0.0844 | PPARG | NM_005037 |
| HB-EGF | 0.50 | 1.38 | 0.0845 | HBEGF | NM_001945 |
| RARA | 1.77 | 0.96 | 0.0848 | RARA | NM_000964 |
| GCNT1 | 1.86 | 1.07 | 0.0883 | GCNT1 | NM_001490 |
| Ki-67 | 1.53 | 0.86 | 0.0885 | MKI67 | NM_002417 |
| EFNB2 | 1.76 | 1.05 | 0.0895 | EFNB2 | NM_004093 |
| LGMN | 0.59 | 1.37 | 0.0900 | LGMN | NM_001008530 |
| DKK1 | 0.68 | 1.51 | 0.0922 | DKK1 | NM_012242 |
| MADH4 | 2.04 | 0.98 | 0.0964 | SMAD4 | NM_005359 |
| BIK | 1.53 | 0.94 | 0.0966 | BIK | NM_001197 |
| CD44v3 | 1.58 | 0.97 | 0.0996 | | AJ251595v3 |

TABLE A

| Gene | Accession | Reagent | Sequence | Sequence ID Number |
|---|---|---|---|---|
| A-Catenin | NM_001903.1 | Forward Primer | CGTTCCGATCCTCTATACTGCAT | SEQ ID NO: 1 |
| | | Probe | ATGCCTACAGCACCCTGATGTCGCA | SEQ ID NO: 2 |
| | | Reverse Primer | AGGTCCCTGTTGGCCTTATAGG | SEQ ID NO: 3 |

TABLE A-continued

| Gene | Accession | Reagent | Sequence | Sequence ID Number |
|---|---|---|---|---|
| ABCB1 | NM_000927.2 | Forward Primer<br>Probe<br>Reverse Primer | AAACACCACTGGAGCATTGA<br>CTCGCCAATGATGCTGCTCAAGTT<br>CAAGCCTGGAACCTATAGCC | SEQ ID NO: 4<br>SEQ ID NO: 5<br>SEQ ID NO: 6 |
| ABCC5 | NM_005688.1 | Forward Primer<br>Probe<br>Reverse Primer | TGCAGACTGTACCATGCTGA<br>CTGCACACGGTTCTAGGCTCCG<br>GGCCAGCACCATAATCCTAT | SEQ ID NO: 7<br>SEQ ID NO: 8<br>SEQ ID NO: 9 |
| ABCC6 | NM_001171.2 | Forward Primer<br>Probe<br>Reverse Primer | GGATGAACCTCGACCTGC<br>CCAGATAGCCTCGTCCGAGTGCTC<br>GAGCTGCACCGTCTCCAG | SEQ ID NO: 10<br>SEQ ID NO: 11<br>SEQ ID NO: 12 |
| ACP1 | NM_004300.2 | Forward Primer<br>Probe<br>Reverse Primer | GCTACCAAGTCCGTGCTGT<br>TGATCGACAAATGTTACCCAGACACACA<br>GAAAACTGCTTCTGCAATGG | SEQ ID NO: 13<br>SEQ ID NO: 14<br>SEQ ID NO: 15 |
| ADAM10 | NM_001110.1 | Forward Primer<br>Probe<br>Reverse Primer | CCCATCAACTTGTGCCAGTA<br>TGCCTACTCCACTGCACAGACCCT<br>GGTGATGGTTCGACCACTG | SEQ ID NO: 16<br>SEQ ID NO: 17<br>SEQ ID NO: 18 |
| ADAM17 | NM_003183.3 | Forward Primer<br>Probe<br>Reverse Primer | GAAGTGCCAGGAGGCGATTA<br>TGCTACTTGCAAAGGCGTGTCCTACTGC<br>CGGGCACTCACTGCTATTACC | SEQ ID NO: 19<br>SEQ ID NO: 20<br>SEQ ID NO: 21 |
| ADAMTS12 | NM_030955.2 | Forward Primer<br>Probe<br>Reverse Primer | GGAGAAGGGTGGAGTGCAG<br>CGCACAGTCAGAATCCATCTGGGT<br>CAGGGTCAGGTCTCTGGATG | SEQ ID NO: 22<br>SEQ ID NO: 23<br>SEQ ID NO: 24 |
| ADPRT | NM_001618.2 | Forward Primer<br>Probe<br>Reverse Primer | TTGACAACCTGCTGGACATC<br>CCCTGAGCAGACTGTAGGCCACCT<br>ATGGGATCCTTGCTGCTATC | SEQ ID NO: 25<br>SEQ ID NO: 26<br>SEQ ID NO: 27 |
| AGXT | NM_000030.1 | Forward Primer<br>Probe<br>Reverse Primer | CTTTTCCCTCCAGTGGCA<br>CTCCTGGAAACAGTCCACTTGGGC<br>ATTTGGAAGGCACTGGGTTT | SEQ ID NO: 28<br>SEQ ID NO: 29<br>SEQ ID NO: 30 |
| AKAP12 | NM_005100.2 | Forward Primer<br>Probe<br>Reverse Primer | TAGAGAGCCCCTGACAATCC<br>TGGCTCTAGCTCCTGATGAAGCCTC<br>GGTTGGTCTTGGAAAGAGGA | SEQ ID NO: 31<br>SEQ ID NO: 32<br>SEQ ID NO: 33 |
| AKT1 | NM_005163.1 | Forward Primer<br>Probe<br>Reverse Primer | CGCTTCTATGGCGCTGAGAT<br>CAGCCCTGGACTACCTGCACTCGG<br>TCCCGGTACACCACGTTCTT | SEQ ID NO: 34<br>SEQ ID NO: 35<br>SEQ ID NO: 36 |
| AKT2 | NM_001626.2 | Forward Primer<br>Probe<br>Reverse Primer | TCCTGCCACCCTTCAAACC<br>CAGGTCACGTCCGAGGTCGACACA<br>GGCGGTAAATTCATCATCGAA | SEQ ID NO: 37<br>SEQ ID NO: 38<br>SEQ ID NO: 39 |
| AKT3 | NM_005465.1 | Forward Primer<br>Probe<br>Reverse Primer | TTGTCTCTGCCTTGGACTATCTACA<br>TCACGGTACACAATCTTTCCGGA<br>CCAGCATTAGATTCTCCAACTTGA | SEQ ID NO: 40<br>SEQ ID NO: 41<br>SEQ ID NO: 42 |
| AL137428 | AL137428.1 | Forward Primer<br>Probe<br>Reverse Primer | CAAGAAGAGGCTCTACCCTGG<br>ACTGGGAATTTCCAAGGCCACCTT<br>AAATGAGCTCTGCGATCCTC | SEQ ID NO: 43<br>SEQ ID NO: 44<br>SEQ ID NO: 45 |
| ALCAM | NM_001627.1 | Forward Primer<br>Probe<br>Reverse Primer | GAGGAATATGGAATCCAAGGG<br>CCAGTTCCTGCCGTCTGCTCTTCT<br>GTGGCGGAGATCAAGAGG | SEQ ID NO: 46<br>SEQ ID NO: 47<br>SEQ ID NO: 48 |
| ALDH1A1 | NM_000689.1 | Forward Primer<br>Probe<br>Reverse Primer | GAAGGAGATAAGGAGGATGTTGACA<br>AGTGAAGGCCGCAAGACAGGCTTTTC<br>CGCCACGGAGATCCAATC | SEQ ID NO: 49<br>SEQ ID NO: 50<br>SEQ ID NO: 51 |
| ALDOA | NM_000034.2 | Forward Primer<br>Probe<br>Reverse Primer | GCCTGTACGTGCCAGCTC<br>TGCCAGAGCCTCAACTGTCTCTGC<br>TCATCGGAGCTTGATCTCG | SEQ ID NO: 52<br>SEQ ID NO: 53<br>SEQ ID NO: 54 |
| AMFR | NM_001144.2 | Forward Primer<br>Probe<br>Reverse Primer | GATGGTTCAGCTCTGCAAGGA<br>CGATTTGAATATCTTTCCTTCTCGCCCACC<br>TCGACCGTGGCTGCTCAT | SEQ ID NO: 55<br>SEQ ID NO: 56<br>SEQ ID NO: 57 |
| ANGPT2 | NM_001147.1 | Forward Primer<br>Probe<br>Reverse Primer | CCGTGAAAGCTGCTCTGTAA<br>AAGCTGACACAGCCCTCCCAAGTG<br>TTGCAGTGGGAAGAACAGTC | SEQ ID NO: 58<br>SEQ ID NO: 59<br>SEQ ID NO: 60 |

TABLE A-continued

| Gene | Accession | Reagent | Sequence | Sequence ID Number |
|---|---|---|---|---|
| ANTXR1 | NM_032208.1 | Forward Primer | CTCCAGGTGTACCTCCAACC | SEQ ID NO: 61 |
| | | Probe | AGCCTTCTCCCACAGCTGCCTACA | SEQ ID NO: 62 |
| | | Reverse Primer | GAGAAGGCTGGGAGACTCTG | SEQ ID NO: 63 |
| ANXA1 | NM_000700.1 | Forward Primer | GCCCCTATCCTACCTTCAATCC | SEQ ID NO: 64 |
| | | Probe | TCCTCGGATGTCGCTGCCT | SEQ ID NO: 65 |
| | | Reverse Primer | CCTTTAACCATTATGGCCTTATGC | SEQ ID NO: 66 |
| ANXA2 | NM_004039.1 | Forward Primer | CAAGACACTAAGGGCGACTACCA | SEQ ID NO: 67 |
| | | Probe | CCACCACACAGGTACAGCAGCGCT | SEQ ID NO: 68 |
| | | Reverse Primer | CGTGTCGGGCTTCAGTCAT | SEQ ID NO: 69 |
| ANXA5 | NM_001154.2 | Forward Primer | GCTCAAGCCTGGAAGATGAC | SEQ ID NO: 70 |
| | | Probe | AGTACCCTGAAGTGTCCCCCACCA | SEQ ID NO: 71 |
| | | Reverse Primer | AGAACCACCAACATCCGCT | SEQ ID NO: 72 |
| AP-1 (JUN official) | NM_002228.2 | Forward Primer | GACTGCAAAGATGGAAACGA | SEQ ID NO: 73 |
| | | Probe | CTATGACGATGCCCTCAACGCCTC | SEQ ID NO: 74 |
| | | Reverse Primer | TAGCCATAAGGTCCGCTCTC | SEQ ID NO: 75 |
| APC | NM_000038.1 | Forward Primer | GGACAGCAGGAATGTGTTTC | SEQ ID NO: 76 |
| | | Probe | CATTGGCTCCCCGTGACCTGTA | SEQ ID NO: 77 |
| | | Reverse Primer | ACCCACTCGATTTGTTTCTG | SEQ ID NO: 78 |
| APEX-1 | NM_001641.2 | Forward Primer | GATGAAGCCTTTCGCAAGTT | SEQ ID NO: 79 |
| | | Probe | CTTTCGGGAAGCCAGGCCCTT | SEQ ID NO: 80 |
| | | Reverse Primer | AGGTCTCCACACAGCACAAG | SEQ ID NO: 81 |
| APG-1 | NM_014278.2 | Forward Primer | ACCCCGGCCTGTATATCAT | SEQ ID NO: 82 |
| | | Probe | CCAATGGCTCGAGTTCTTGATCCC | SEQ ID NO: 83 |
| | | Reverse Primer | CTATCTGGCTCTTTGCTGCAT | SEQ ID NO: 84 |
| APN (ANPEP official) | NM_001150.1 | Forward Primer | CCACCTTGGACCAAAGTAAAGC | SEQ ID NO: 85 |
| | | Probe | CTCCCCAACACGCTGAAACCCG | SEQ ID NO: 86 |
| | | Reverse Primer | TCTCAGCGTCACCTGGTAGGA | SEQ ID NO: 87 |
| APOC1 | NM_001645.3 | Forward Primer | GGAAACACACTGGAGGACAAG | SEQ ID NO: 88 |
| | | Probe | TCATCAGCCGCATCAAACAGAGTG | SEQ ID NO: 89 |
| | | Reverse Primer | CGCATCTTGGCAGAAAGTT | SEQ ID NO: 90 |
| AREG | NM_001657.1 | Forward Primer | TGTGAGTGAAATGCCTTCTAGTAGTGA | SEQ ID NO: 91 |
| | | Probe | CCGTCCTCGGGAGCCGACTATGA | SEQ ID NO: 92 |
| | | Reverse Primer | TTGTGGTTCGTTATCATACTCTTCTGA | SEQ ID NO: 93 |
| ARG | NM_005158.2 | Forward Primer | CGCAGTGCAGCTGAGTATCTG | SEQ ID NO: 94 |
| | | Probe | TCGCACCAGGAAGCTGCCATTGA | SEQ ID NO: 95 |
| | | Reverse Primer | TGCCCAGGGCTACTCTCACTT | SEQ ID NO: 96 |
| ARHF | NM_019034.2 | Forward Primer | ACTGGCCCACTTAGTCCTCA | SEQ ID NO: 97 |
| | | Probe | CTCCCAACCTGCTGTCCCTCAAG | SEQ ID NO: 98 |
| | | Reverse Primer | CTGAACTCCACAGGCTGGTA | SEQ ID NO: 99 |
| ATOH1 | NM_005172.1 | Forward Primer | GCAGCCACCTGCAACTTT | SEQ ID NO: 100 |
| | | Probe | CAGGCGAGAGAGCATCCCGTCTAC | SEQ ID NO: 101 |
| | | Reverse Primer | TCCAGGAGGGACAGCTCA | SEQ ID NO: 102 |
| ATP5A1 | NM_004046.3 | Forward Primer | GATGCTGCCACTCAACAACT | SEQ ID NO: 103 |
| | | Probe | AGTTAGACGCACGCCACGACTCAA | SEQ ID NO: 104 |
| | | Reverse Primer | TGTCCTTGCTTCAGCAACTC | SEQ ID NO: 105 |
| ATP5E | NM_006886.2 | Forward Primer | CCGCTTTCGCTACAGCAT | SEQ ID NO: 106 |
| | | Probe | TCCAGCCTGTCTCCAGTAGGCCAC | SEQ ID NO: 107 |
| | | Reverse Primer | TGGGAGTATCGGATGTAGCTG | SEQ ID NO: 108 |
| AURKB | NM_004217.1 | Forward Primer | AGCTGCAGAAGAGCTGCACAT | SEQ ID NO: 109 |
| | | Probe | TGACGAGCAGCGAACAGCCACG | SEQ ID NO: 110 |
| | | Reverse Primer | GCATCTGCCAACTCCTCCAT | SEQ ID NO: 111 |
| Axin 2 | NM_004655.2 | Forward Primer | GGCTATGTCTTTGCACCAGC | SEQ ID NO: 112 |
| | | Probe | ACCAGCGCCAACGACAGTGAGATA | SEQ ID NO: 113 |
| | | Reverse Primer | ATCCGTCAGCGCATCACT | SEQ ID NO: 114 |
| axin1 | NM_003502.2 | Forward Primer | CCGTGTGACAGCATCGTT | SEQ ID NO: 115 |
| | | Probe | CGTACTACTTCTGCGGGGAACCCA | SEQ ID NO: 116 |
| | | Reverse Primer | CTCACCAGGGTGCGGTAG | SEQ ID NO: 117 |

TABLE A-continued

| Gene | Accession | Reagent | Sequence | Sequence ID Number |
|---|---|---|---|---|
| B-Catenin | NM_001904.1 | Forward Primer<br>Probe<br>Reverse Primer | GGCTCTTGTGCGTACTGTCCTT<br>AGGCTCAGTGATGTCTTCCCTGTCACCAG<br>TCAGATGACGAAGAGCACAGATG | SEQ ID NO: 118<br>SEQ ID NO: 119<br>SEQ ID NO: 120 |
| BAD | NM_032989.1 | Forward Primer<br>Probe<br>Reverse Primer | GGGTCAGGTGCCTCGAGAT<br>TGGGCCCAGAGCATGTTCCAGATC<br>CTGCTCACTCGGCTCAAACTC | SEQ ID NO: 121<br>SEQ ID NO: 122<br>SEQ ID NO: 123 |
| BAG1 | NM_004323.2 | Forward Primer<br>Probe<br>Reverse Primer | CGTTGTCAGCACTTGGAATACAA<br>CCCAATTAACATGACCCGGCAACCAT<br>GTTCAACCTCTTCCTGTGGACTGT | SEQ ID NO: 124<br>SEQ ID NO: 125<br>SEQ ID NO: 126 |
| BAG2 | NM_004282.2 | Forward Primer<br>Probe<br>Reverse Primer | CTAGGGGCAAAAAGCATGA<br>TTCCATGCCAGACAGGAAAAAGCA<br>CTAAATGCCCAAGGTGACTG | SEQ ID NO: 127<br>SEQ ID NO: 128<br>SEQ ID NO: 129 |
| BAG3 | NM_004281.2 | Forward Primer<br>Probe<br>Reverse Primer | GAAAGTAAGCCAGGCCCAGTT<br>CAGAACTCCTCCTGGACACATCCCAA<br>ACCTCTTTGCGGATCACTTGA | SEQ ID NO: 130<br>SEQ ID NO: 131<br>SEQ ID NO: 132 |
| Bak | NM_001188.1 | Forward Primer<br>Probe<br>Reverse Primer | CCATTCCCACCATTCTACCT<br>ACACCCCAGACGTCCTGGCCT<br>GGGAACATAGACCCACCAAT | SEQ ID NO: 133<br>SEQ ID NO: 134<br>SEQ ID NO: 135 |
| Bax | NM_004324.1 | Forward Primer<br>Probe<br>Reverse Primer | CCGCCGTGGACACAGACT<br>TGCCACTCGGAAAAAGACCTCTCGG<br>TTGCCGTCAGAAAACATGTCA | SEQ ID NO: 136<br>SEQ ID NO: 137<br>SEQ ID NO: 138 |
| BBC3 | NM_014417.1 | Forward Primer<br>Probe<br>Reverse Primer | CCTGGAGGGTCCTGTACAAT<br>CATCATGGGACTCCTGCCCTTACC<br>CTAATTGGGCTCCATCTCG | SEQ ID NO: 139<br>SEQ ID NO: 140<br>SEQ ID NO: 141 |
| BCAS1 | NM_003657.1 | Forward Primer<br>Probe<br>Reverse Primer | CCCCGAGACAACGGAGATAA<br>CTTTCCGTTGGCATCCGCAACAG<br>CTCGGGTTTGGCCTCTTTC | SEQ ID NO: 142<br>SEQ ID NO: 143<br>SEQ ID NO: 144 |
| Bcl2 | NM_000633.1 | Forward Primer<br>Probe<br>Reverse Primer | CAGATGGACCTAGTACCCACTGAGA<br>TTCCACGCCGAAGGACAGCGAT<br>CCTATGATTTAAGGGCATTTTTCC | SEQ ID NO: 145<br>SEQ ID NO: 146<br>SEQ ID NO: 147 |
| BCL2L10 | NM_020396.2 | Forward Primer<br>Probe<br>Reverse Primer | GCTGGGATGGCTTTTGTCA<br>TCTTCAGGACCCCCTTTCCACTGGC<br>GCCTGGACCAGCTGTTTTCTC | SEQ ID NO: 148<br>SEQ ID NO: 149<br>SEQ ID NO: 150 |
| BCL2L11 | NM_138621.1 | Forward Primer<br>Probe<br>Reverse Primer | AATTACCAAGCAGCCGAAGA<br>CCACCCACGAATGGTTATCTTACGACTG<br>CAGGCGGACAATGTAACGTA | SEQ ID NO: 151<br>SEQ ID NO: 152<br>SEQ ID NO: 153 |
| BCL2L12 | NM_138639.1 | Forward Primer<br>Probe<br>Reverse Primer | AACCCACCCCTGTCTTGG<br>TCCGGGTAGCTCTCAAACTCGAGG<br>CTCAGCTGACGGGAAAGG | SEQ ID NO: 154<br>SEQ ID NO: 155<br>SEQ ID NO: 156 |
| Bclx | NM_001191.1 | Forward Primer<br>Probe<br>Reverse Primer | CTTTTGTGGAACTCTATGGGAACA<br>TTCGGCTCTCGGCTGCTGCA<br>CAGCGGTTGAAGCGTTCCT | SEQ ID NO: 157<br>SEQ ID NO: 158<br>SEQ ID NO: 159 |
| BCRP | NM_004827.1 | Forward Primer<br>Probe<br>Reverse Primer | TGTACTGGCGAAGAATATTTGGTAAA<br>CAGGGCATCGATCTCTCACCCTGG<br>GCCACGTGATTCTTCCACAA | SEQ ID NO: 160<br>SEQ ID NO: 161<br>SEQ ID NO: 162 |
| BFGF | NM_007083.1 | Forward Primer<br>Probe<br>Reverse Primer | CCAGGAAGAATGCTTAAGATGTGA<br>TTCGCCAGGTCATTGAGATCCATCCA<br>TGGTGATGGGAGTTGTATTTTCAG | SEQ ID NO: 163<br>SEQ ID NO: 164<br>SEQ ID NO: 165 |
| BGN | NM_001711.3 | Forward Primer<br>Probe<br>Reverse Primer | GAGCTCCGCAAGGATGAC<br>CAAGGGTCTCCAGCACCTCTACGC<br>CTTGTTGTTCACCAGGACGA | SEQ ID NO: 166<br>SEQ ID NO: 167<br>SEQ ID NO: 168 |
| BID | NM_001196.2 | Forward Primer<br>Probe<br>Reverse Primer | GGACTGTGAGGTCAACAACG<br>TGTGATGCACTCATCCCTGAGGCT<br>GGAAGCCAAACACCAGTAGG | SEQ ID NO: 169<br>SEQ ID NO: 170<br>SEQ ID NO: 171 |
| BIK | NM_001197.3 | Forward Primer<br>Probe<br>Reverse Primer | ATTCCTATGGCTCTGCAATTGTC<br>CCGGTTAACTGTGGCCTGTGCCC<br>GGCAGGAGTGAATGGCTCTTC | SEQ ID NO: 172<br>SEQ ID NO: 173<br>SEQ ID NO: 174 |

TABLE A-continued

| Gene | Accession | Reagent | Sequence | Sequence ID Number |
|---|---|---|---|---|
| BIN1 | NM_004305.1 | Forward Primer<br>Probe<br>Reverse Primer | CCTGCAAAAGGGAACAAGAG<br>CTTCGCCTCCAGATGGCTCCC<br>CGTGGTTGACTCTGATCTCG | SEQ ID NO: 175<br>SEQ ID NO: 176<br>SEQ ID NO: 177 |
| BLMH | NM_000386.2 | Forward Primer<br>Probe<br>Reverse Primer | GGTTGCTGCCTCCATCAAAG<br>ACATCACAGCCAAACCACACAGCCTCT<br>CCAGCTTGCTATTGAAGTGTTTTC | SEQ ID NO: 178<br>SEQ ID NO: 179<br>SEQ ID NO: 180 |
| BMP2 | NM_001200.1 | Forward Primer<br>Probe<br>Reverse Primer | ATGTGGACGCTCTTTCAATG<br>ACCGCAGTCCGTCTAAGAAGCACG<br>ACCATGGTCGACCTTTAGGA | SEQ ID NO: 181<br>SEQ ID NO: 182<br>SEQ ID NO: 183 |
| BMP4 | NM_001202.2 | Forward Primer<br>Probe<br>Reverse Primer | GGGCTAGCCATTGAGGTG<br>CTCACCTCCATCAGACTCGGACCC<br>GCTAATCCTGACATGCTGGC | SEQ ID NO: 184<br>SEQ ID NO: 185<br>SEQ ID NO: 186 |
| BMP7 | NM_001719.1 | Forward Primer<br>Probe<br>Reverse Primer | TCGTGGAACATGACAAGGAATT<br>TTCCACCCACGCTACCACCATCG<br>TGGAAAGATCAAACCGGAACTC | SEQ ID NO: 187<br>SEQ ID NO: 188<br>SEQ ID NO: 189 |
| BMPR1A | NM_004329.2 | Forward Primer<br>Probe<br>Reverse Primer | TTGGTTCAGCGAACTATTGC<br>CAAACAGATTCAGATGGTCCGGCA<br>TCTCCATATCGGCCTTTACC | SEQ ID NO: 190<br>SEQ ID NO: 191<br>SEQ ID NO: 192 |
| BRAF | NM_004333.1 | Forward Primer<br>Probe<br>Reverse Primer | CCTTCCGACCAGCAGATGAA<br>CAATTTGGGCAACGAGACCGATCCT<br>TTTATATGCACATTGGGAGCTGAT | SEQ ID NO: 193<br>SEQ ID NO: 194<br>SEQ ID NO: 195 |
| BRCA1 | NM_007295.1 | Forward Primer<br>Probe<br>Reverse Primer | TCAGGGGGCTAGAAATCTGT<br>CTATGGGCCCTTCACCAACATGC<br>CCATTCCAGTTGATCTGTGG | SEQ ID NO: 196<br>SEQ ID NO: 197<br>SEQ ID NO: 198 |
| BRCA2 | NM_000059.1 | Forward Primer<br>Probe<br>Reverse Primer | AGTTCGTGCTTTGCAAGATG<br>CATTCTTCACTGCTTCATAAAGCTCTGCA<br>AAGGTAAGCTGGGTCTGCTG | SEQ ID NO: 199<br>SEQ ID NO: 200<br>SEQ ID NO: 201 |
| BRK | NM_005975.1 | Forward Primer<br>Probe<br>Reverse Primer | GTGCAGGAAAGGTTCACAAA<br>AGTGTCTGCGTCCAATACACGCGT<br>GCACACACGATGGAGTAAGG | SEQ ID NO: 202<br>SEQ ID NO: 203<br>SEQ ID NO: 204 |
| BTF3 | NM_001207.2 | Forward Primer<br>Probe<br>Reverse Primer | CAGTGATCCACTTTAACAACCCTAAAG<br>TCAGGCATCTCTGGCAGCGAACAC<br>AGCATGGCCTGTAATGGTGAA | SEQ ID NO: 205<br>SEQ ID NO: 206<br>SEQ ID NO: 207 |
| BTRC | NM_033637.2 | Forward Primer<br>Probe<br>Reverse Primer | GTTGGGACACAGTTGGTCTG<br>CAGTCGGCCCAGGACGGTCTACT<br>TGAAGCAGTCAGTTGTGCTG | SEQ ID NO: 208<br>SEQ ID NO: 209<br>SEQ ID NO: 210 |
| BUB1 | NM_004336.1 | Forward Primer<br>Probe<br>Reverse Primer | CCGAGGTTAATCCAGCACGTA<br>TGCTGGGAGCCTACACTTGGCCC<br>AAGACATGGCGCTCTCAGTTC | SEQ ID NO: 211<br>SEQ ID NO: 212<br>SEQ ID NO: 213 |
| BUB1B | NM_001211.3 | Forward Primer<br>Probe<br>Reverse Primer | TCAACAGAAGGCTGAACCACTAGA<br>TACAGTCCCAGCACCGACAATTCC<br>CAACAGAGTTTGCCGAGACACT | SEQ ID NO: 214<br>SEQ ID NO: 215<br>SEQ ID NO: 216 |
| BUB3 | NM_004725.1 | Forward Primer<br>Probe<br>Reverse Primer | CTGAAGCAGATGGTTCATCATT<br>CCTCGCTTTGTTTAACAGCCCAGG<br>GCTGATTCCCAAGAGTCTAACC | SEQ ID NO: 217<br>SEQ ID NO: 218<br>SEQ ID NO: 219 |
| c-abl | NM_005157.2 | Forward Primer<br>Probe<br>Reverse Primer | CCATCTCGCTGAGATACGAA<br>GGGAGGGTGTACCATTACAGGATCAACA<br>AGACGTAGAGCTTGCCATCA | SEQ ID NO: 220<br>SEQ ID NO: 221<br>SEQ ID NO: 222 |
| c-kit | NM_000222.1 | Forward Primer<br>Probe<br>Reverse Primer | GAGGCAACTGCTTATGGCTTAATTA<br>TTACAGCGACAGTCATGGCCGCAT<br>GGCACTCGGCTTGAGCAT | SEQ ID NO: 223<br>SEQ ID NO: 224<br>SEQ ID NO: 225 |
| c-myb (MYB official) | NM_005375.1 | Forward Primer<br>Probe<br>Reverse Primer | AACTCAGACTTGGAAATGCCTTCT<br>AACTTCCACCCCCCTCATTGGTCACA<br>CTGGTCTCTATGAAATGGTGTTGTAAC | SEQ ID NO: 226<br>SEQ ID NO: 227<br>SEQ ID NO: 228 |
| c-Src | NM_005417.3 | Forward Primer<br>Probe<br>Reverse Primer | TGAGGAGTGGTATTTTGGCAAGA<br>AACCGCTCTGACTCCGTCTGGTG<br>CTCTCGGGTTCTCTGCATTGA | SEQ ID NO: 229<br>SEQ ID NO: 230<br>SEQ ID NO: 231 |

TABLE A-continued

| Gene | Accession | Reagent | Sequence | Sequence ID Number |
|---|---|---|---|---|
| C20 orf1 | NM_012112.2 | Forward Primer<br>Probe<br>Reverse Primer | TCAGCTGTGAGCTGCGGATA<br>CAGGTCCCATTGCCGGGCG<br>ACGGTCCTAGGTTTGAGGTTAAGA | SEQ ID NO: 232<br>SEQ ID NO: 233<br>SEQ ID NO: 234 |
| C20ORF126 | NM_030815.2 | Forward Primer<br>Probe<br>Reverse Primer | CCAGCACTGCTCGTTACTGT<br>TGGGACCTCAGACCACTGAAGGC<br>TTGACTTCACGGCAGTTCATA | SEQ ID NO: 235<br>SEQ ID NO: 236<br>SEQ ID NO: 237 |
| C8orf4 | NM_020130.2 | Forward Primer<br>Probe<br>Reverse Primer | CTACGAGTCAGCCCATCCAT<br>CATGGCTACCACTTCGCACAGCC<br>TGCCCACGGCTTTCTTAC | SEQ ID NO: 238<br>SEQ ID NO: 239<br>SEQ ID NO: 240 |
| CA9 | NM_001216.1 | Forward Primer<br>Probe<br>Reverse Primer | ATCCTAGCCCTGGTTTTTGG<br>TTTGCTGTCACCAGCGTCGC<br>CTGCCTTCTCATCTGCACAA | SEQ ID NO: 241<br>SEQ ID NO: 242<br>SEQ ID NO: 243 |
| Cad17 | NM_004063.2 | Forward Primer<br>Probe<br>Reverse Primer | GAAGGCCAAGAACCGAGTCA<br>TTATATTCCAGTTTAAGGCCAATCCTC<br>TCCCCAGTTAGTTCAAAAGTCACA | SEQ ID NO: 244<br>SEQ ID NO: 245<br>SEQ ID NO: 246 |
| CALD1 | NM_004342.4 | Forward Primer<br>Probe<br>Reverse Primer | CACTAAGGTTTGAGACAGTTCCAGAA<br>AACCCAAGCTCAAGACGCAGGACGAG<br>GCGAATTAGCCCTCTACAACTGA | SEQ ID NO: 247<br>SEQ ID NO: 248<br>SEQ ID NO: 249 |
| CAPG | NM_001747.1 | Forward Primer<br>Probe<br>Reverse Primer | GATTGTCACTGATGGGGAGG<br>AGGACCTGGATCATCTCAGCAGGC<br>CCTTCAGAGCAGGCTTGG | SEQ ID NO: 250<br>SEQ ID NO: 251<br>SEQ ID NO: 252 |
| CAPN1 | NM_005186.2 | Forward Primer<br>Probe<br>Reverse Primer | CAAGAAGCTGTACGAGCTCATCA<br>CCGCTACTCGGAGCCCGACCTG<br>GCAGCAAACGAAATTGTCAAAG | SEQ ID NO: 253<br>SEQ ID NO: 254<br>SEQ ID NO: 255 |
| CASP8 | NM_033357.1 | Forward Primer<br>Probe<br>Reverse Primer | CCTCGGGGATACTGTCTGAT<br>CAACAATCACAATTTTGCAAAAGCACG<br>GAAGTTTGGGCACTTTCTCC | SEQ ID NO: 256<br>SEQ ID NO: 257<br>SEQ ID NO: 258 |
| CASP9 | NM_001229.2 | Forward Primer<br>Probe<br>Reverse Primer | TGAATGCCGTGGATTGCA<br>CACTAGCCCTGGACCAGCCACTGCT<br>ACAGGGATCATGGGACACAAG | SEQ ID NO: 259<br>SEQ ID NO: 260<br>SEQ ID NO: 261 |
| CAT | NM_001752.1 | Forward Primer<br>Probe<br>Reverse Primer | ATCCATTCGATCTCACCAAGGT<br>TGGCCTCACAAGGACTACCCTCTCATCC<br>TCCGGTTTAAGACCAGTTTACCA | SEQ ID NO: 262<br>SEQ ID NO: 263<br>SEQ ID NO: 264 |
| CAV1 | NM_001753.3 | Forward Primer<br>Probe<br>Reverse Primer | GTGGCTCAACATTGTGTTCC<br>ATTTCAGCTGATCAGTGGGCCTCC<br>CAATGGCCTCCATTTTACAG | SEQ ID NO: 265<br>SEQ ID NO: 266<br>SEQ ID NO: 267 |
| CBL | NM_005188.1 | Forward Primer<br>Probe<br>Reverse Primer | TCATTCACAAACCTGGCAGT<br>TTCCGGCTGAGCTGTACTCGTCTG<br>CATACCCAATAGCCCACTGA | SEQ ID NO: 268<br>SEQ ID NO: 269<br>SEQ ID NO: 270 |
| CCL20 | NM_004591.1 | Forward Primer<br>Probe<br>Reverse Primer | CCATGTGCTGTACCAAGAGTTTG<br>CAGCACTGACATCAAAGCAGCCAGGA<br>CGCCGCAGAGGTGGAGTA | SEQ ID NO: 271<br>SEQ ID NO: 272<br>SEQ ID NO: 273 |
| CCL3 | NM_002983.1 | Forward Primer<br>Probe<br>Reverse Primer | AGCAGACAGTGGTCAGTCCTT<br>CTCTGCTGACACTCGAGCCCACAT<br>CTGCATGATTCTGAGCAGGT | SEQ ID NO: 274<br>SEQ ID NO: 275<br>SEQ ID NO: 276 |
| CCNA2 | NM_001237.2 | Forward Primer<br>Probe<br>Reverse Primer | CCATACCTCAAGTATTTGCCATCAG<br>ATTGCTGGAGCTGCCTTTCATTTAGCACT<br>AGCTTTGTCCCGTGACTGTGTA | SEQ ID NO: 277<br>SEQ ID NO: 278<br>SEQ ID NO: 279 |
| CCNB1 | NM_031966.1 | Forward Primer<br>Probe<br>Reverse Primer | TTCAGGTTGTTGCAGGAGAC<br>TGTCTCCATTATTGATCGGTTCATGCA<br>CATCTTCTTGGGCACACAAT | SEQ ID NO: 280<br>SEQ ID NO: 281<br>SEQ ID NO: 282 |
| CCNB2 | NM_004701.2 | Forward Primer<br>Probe<br>Reverse Primer | AGGCTTCTGCAGGAGACTCTGT<br>TCGATCCATAATGCCAACGCACATG<br>GGGAAACTGGCTGAACCTGTAA | SEQ ID NO: 283<br>SEQ ID NO: 284<br>SEQ ID NO: 285 |
| CCND1 | NM_001758.1 | Forward Primer<br>Probe<br>Reverse Primer | GCATGTTCGTGGCCTCTAAGA<br>AAGGAGACCATCCCCCTGACGGC<br>CGGTGTAGATGCACAGCTTCTC | SEQ ID NO: 286<br>SEQ ID NO: 287<br>SEQ ID NO: 288 |

TABLE A-continued

| Gene | Accession | Reagent | Sequence | Sequence ID Number |
|---|---|---|---|---|
| CCND3 | NM_001760.2 | Forward Primer<br>Probe<br>Reverse Primer | CCTCTGTGCTACAGATTATACCTTTGC<br>TACCCGCCATCCATGATCGCCA<br>CACTGCAGCCCCAATGCT | SEQ ID NO: 289<br>SEQ ID NO: 290<br>SEQ ID NO: 291 |
| CCNE1 | NM_001238.1 | Forward Primer<br>Probe<br>Reverse Primer | AAAGAAGATGATGACCGGGTTTAC<br>CAAACTCAACGTGCAAGCCTCGGA<br>GAGCCTCTGGATGGTGCAAT | SEQ ID NO: 292<br>SEQ ID NO: 293<br>SEQ ID NO: 294 |
| CCNE2 | NM_057749.1 | Forward Primer<br>Probe<br>Reverse Primer | GGTCACCAAGAAACATCAGTATGAA<br>CCCAGATAATACAGGTGGCCAACAATTCCT<br>TTCAATGATAATGCAAGGACTGATC | SEQ ID NO: 295<br>SEQ ID NO: 296<br>SEQ ID NO: 297 |
| CCNE2 variant 1 | NM_057749var1 | Forward Primer<br>Probe<br>Reverse Primer | ATGCTGTGGCTCCTTCCTAACT<br>TACCAAGCAACCTACATGTCAAGAAAGCCC<br>ACCCAAATTGTGATATACAAAAAGGTT | SEQ ID NO: 298<br>SEQ ID NO: 299<br>SEQ ID NO: 300 |
| CCR7 | NM_001838.2 | Forward Primer<br>Probe<br>Reverse Primer | GGATGACATGCACTCAGCTC<br>CTCCCATCCCAGTGGAGCCAA<br>CCTGACATTTCCCTTGTCCT | SEQ ID NO: 301<br>SEQ ID NO: 302<br>SEQ ID NO: 303 |
| CD105 | NM_000118.1 | Forward Primer<br>Probe<br>Reverse Primer | GCAGGTGTCAGCAAGTATGATCAG<br>CGACAGGATATTGACCACCGCCTCATT<br>TTTTTCCGCTGTGGTGATGA | SEQ ID NO: 304<br>SEQ ID NO: 305<br>SEQ ID NO: 306 |
| CD134 (TNFRSF4 official) | NM_003327.1 | Forward Primer<br>Probe<br>Reverse Primer | GCCCAGTGCGGAGAACAG<br>CCAGCTTGATTCTCGTCTCTGCACTTAAGC<br>AATCACACGCACCTGGAGAAC | SEQ ID NO: 307<br>SEQ ID NO: 308<br>SEQ ID NO: 309 |
| CD18 | NM_000211.1 | Forward Primer<br>Probe<br>Reverse Primer | CGTCAGGACCCACCATGTCT<br>CGCGGCCGAGACATGGCTTG<br>GGTTAATTGGTGACATCCTCAAGA | SEQ ID NO: 310<br>SEQ ID NO: 311<br>SEQ ID NO: 312 |
| CD24 | NM_013230.1 | Forward Primer<br>Probe<br>Reverse Primer | TCCAACTAATGCCACCACCAA<br>CTGTTGACTGCAGGGCACCACCA<br>GAGAGAGTGAGACCACGAAGAGACT | SEQ ID NO: 313<br>SEQ ID NO: 314<br>SEQ ID NO: 315 |
| CD28 | NM_006139.1 | Forward Primer<br>Probe<br>Reverse Primer | TGTGAAAGGGAAACACCTTTG<br>CCAAGTCCCCTATTTCCCGGACCT<br>AGCACCCAAAAGGGCTTAG | SEQ ID NO: 316<br>SEQ ID NO: 317<br>SEQ ID NO: 318 |
| CD31 | NM_000442.1 | Forward Primer<br>Probe<br>Reverse Primer | TGTATTTCAAGACCTCTGTGCACTT<br>TTTATGAACCTGCCCTGCTCCCACA<br>TTAGCCTGAGGAATTGCTGTGTT | SEQ ID NO: 319<br>SEQ ID NO: 320<br>SEQ ID NO: 321 |
| CD34 | NM_001773.1 | Forward Primer<br>Probe<br>Reverse Primer | CCACTGCACACACCTCAGA<br>CTGTTCTTGGGGCCCTACACCTTG<br>CAGGAGTTTACCTGCCCCT | SEQ ID NO: 322<br>SEQ ID NO: 323<br>SEQ ID NO: 324 |
| CD3z | NM_000734.1 | Forward Primer<br>Probe<br>Reverse Primer | AGATGAAGTGGAAGGCGCTT<br>CACCGCGGCCATCCTGCA<br>TGCCTCTGTAATCGGCAACTG | SEQ ID NO: 325<br>SEQ ID NO: 326<br>SEQ ID NO: 327 |
| CD44E | X55150 | Forward Primer<br>Probe<br>Reverse Primer | ATCACCGACAGCACAGACA<br>CCCTGCTACCAATATGGACTCCAGTCA<br>ACCTGTGTTTGGATTTGCAG | SEQ ID NO: 328<br>SEQ ID NO: 329<br>SEQ ID NO: 330 |
| CD44s | M59040.1 | Forward Primer<br>Probe<br>Reverse Primer | GACGAAGACAGTCCCTGGAT<br>CACCGACAGCACAGACAGAATCCC<br>ACTGGGGTGGAATGTGTCTT | SEQ ID NO: 331<br>SEQ ID NO: 332<br>SEQ ID NO: 333 |
| CD44v3 | AJ251595v3 | Forward Primer<br>Probe<br>Reverse Primer | CACACAAAACAGAACCAGGACT<br>ACCCAGTGGAACCCAAGCCATTC<br>CTGAAGTAGCACTTCCGGATT | SEQ ID NO: 334<br>SEQ ID NO: 335<br>SEQ ID NO: 336 |
| CD44v6 | AJ251595v6 | Forward Primer<br>Probe<br>Reverse Primer | CTCATACCAGCCATCCAATG<br>CACCAAGCCCAGAGGACAGTTCCT<br>TTGGGTTGAAGAAATCAGTCC | SEQ ID NO: 337<br>SEQ ID NO: 338<br>SEQ ID NO: 339 |
| CD68 | NM_001251.1 | Forward Primer<br>Probe<br>Reverse Primer | TGGTTCCCAGCCCTGTGT<br>CTCCAAGCCCAGATTCAGATTCGAGTCA<br>CTCCTCCACCCTGGGTTGT | SEQ ID NO: 340<br>SEQ ID NO: 341<br>SEQ ID NO: 342 |
| CD80 | NM_005191.2 | Forward Primer<br>Probe<br>Reverse Primer | TTCAGTTGCTTTGCAGGAAG<br>TTCTGTGCCCACCATATTCCTCTAGACA<br>TTGATCAAGGTCACCAGAGC | SEQ ID NO: 343<br>SEQ ID NO: 344<br>SEQ ID NO: 345 |

TABLE A-continued

| Gene | Accession | Reagent | Sequence | Sequence ID Number |
|---|---|---|---|---|
| CD82 | NM_002231.2 | Forward Primer | GTGCAGGCTCAGGTGAAGTG | SEQ ID NO: 346 |
| | | Probe | TCAGCTTCTACAACTGGACAGACAACGCTG | SEQ ID NO: 347 |
| | | Reverse Primer | GACCTCAGGGCGATTCATGA | SEQ ID NO: 348 |
| CD8A | NM_171827.1 | Forward Primer | AGGGTGAGGTGCTTGAGTCT | SEQ ID NO: 349 |
| | | Probe | CCAACGGCAAGGGAACAAGTACTTCT | SEQ ID NO: 350 |
| | | Reverse Primer | GGGCACAGTATCCCAGGTA | SEQ ID NO: 351 |
| CD9 | NM_001769.1 | Forward Primer | GGGCGTGGAACAGTTTATCT | SEQ ID NO: 352 |
| | | Probe | AGACATCTGCCCCAAGAAGGACGT | SEQ ID NO: 353 |
| | | Reverse Primer | CACGGTGAAGGTTTCGAGT | SEQ ID NO: 354 |
| CDC2 | NM_001786.2 | Forward Primer | GAGAGCGACGCGGTTGTT | SEQ ID NO: 355 |
| | | Probe | TAGCTGCCGCTGCGGCCG | SEQ ID NO: 356 |
| | | Reverse Primer | GTATGGTAGATCCCGGCTTATTATTC | SEQ ID NO: 357 |
| CDC20 | NM_001255.1 | Forward Primer | TGGATTGGAGTTCTGGGAATG | SEQ ID NO: 358 |
| | | Probe | ACTGGCCGTGGCACTGGACAACA | SEQ ID NO: 359 |
| | | Reverse Primer | GCTTGCACTCCACAGGTACACA | SEQ ID NO: 360 |
| cdc25A | NM_001789.1 | Forward Primer | TCTTGCTGGCTACGCCTCTT | SEQ ID NO: 361 |
| | | Probe | TGTCCCTGTTAGACGTCCTCCGTCCATA | SEQ ID NO: 362 |
| | | Reverse Primer | CTGCATTGTGGCACAGTTCTG | SEQ ID NO: 363 |
| CDC25B | NM_021874.1 | Forward Primer | AAACGAGCAGTTTGCCATCAG | SEQ ID NO: 364 |
| | | Probe | CCTCACCGGCATAGACTGGAAGCG | SEQ ID NO: 365 |
| | | Reverse Primer | GTTGGTGATGTTCCGAAGCA | SEQ ID NO: 366 |
| CDC25C | NM_001790.2 | Forward Primer | GGTGAGCAGAAGTGGCCTAT | SEQ ID NO: 367 |
| | | Probe | CTCCCCGTCGATGCCAGAGAACT | SEQ ID NO: 368 |
| | | Reverse Primer | CTTCAGTCTTGGCCTGTTCA | SEQ ID NO: 369 |
| CDC4 | NM_018315.2 | Forward Primer | GCAGTCCGCTGTGTTCAA | SEQ ID NO: 370 |
| | | Probe | TGCTCCACTAACAACCCTCCTGCC | SEQ ID NO: 371 |
| | | Reverse Primer | GGATCCCACACCTTTACCATAA | SEQ ID NO: 372 |
| CDC42 | NM_001791.2 | Forward Primer | TCCAGAGACTGCTGAAAA | SEQ ID NO: 373 |
| | | Probe | CCCGTGACCTGAAGGCTGTCAAG | SEQ ID NO: 374 |
| | | Reverse Primer | TGTGTAAGTGCAGAACAC | SEQ ID NO: 375 |
| CDC42BPA | NM_003607.2 | Forward Primer | GAGCTGAAAGACGCACACTG | SEQ ID NO: 376 |
| | | Probe | AATTCCTGCATGGCCAGTTTCCTC | SEQ ID NO: 377 |
| | | Reverse Primer | GCCGCTCATTGATCTCCA | SEQ ID NO: 378 |
| CDC6 | NM_001254.2 | Forward Primer | GCAACACTCCCCATTTACCTC | SEQ ID NO: 379 |
| | | Probe | TTGTTCTCCACCAAAGCAAGGCAA | SEQ ID NO: 380 |
| | | Reverse Primer | TGAGGGGGACCATTCTCTTT | SEQ ID NO: 381 |
| CDCA7 v2 | NM_145810.1 | Forward Primer | AAGACCGTGGATGGCTACAT | SEQ ID NO: 382 |
| | | Probe | ATGAAGATGACCTGCCCAGAAGCC | SEQ ID NO: 383 |
| | | Reverse Primer | AGGGTCACGGATGATCTGG | SEQ ID NO: 384 |
| CDH1 | NM_004360.2 | Forward Primer | TGAGTGTCCCCCGGTATCTTC | SEQ ID NO: 385 |
| | | Probe | TGCCAATCCCGATGAAATTGGAAATTT | SEQ ID NO: 386 |
| | | Reverse Primer | CAGCCGCTTTCAGATTTTCAT | SEQ ID NO: 387 |
| CDH11 | NM_001797.2 | Forward Primer | GTCGGCAGAAGCAGGACT | SEQ ID NO: 388 |
| | | Probe | CCTTCTGCCCATAGTGATCAGCGA | SEQ ID NO: 389 |
| | | Reverse Primer | CTACTCATGGGCGGGATG | SEQ ID NO: 390 |
| CDH3 | NM_001793.3 | Forward Primer | ACCCATGTACCGTCCTCG | SEQ ID NO: 391 |
| | | Probe | CCAACCCAGATGAAATCGGCAACT | SEQ ID NO: 392 |
| | | Reverse Primer | CCGCCTTCAGGTTCTCAAT | SEQ ID NO: 393 |
| CDK2 | NM_001798.2 | Forward Primer | AATGCTGCACTACGACCCTA | SEQ ID NO: 394 |
| | | Probe | CCTTGGCCGAAATCCGCTTGT | SEQ ID NO: 395 |
| | | Reverse Primer | TTGGTCACATCCTGGAAGAA | SEQ ID NO: 396 |
| CDX1 | NM_001804.1 | Forward Primer | AGCAACACCAGCCTCCTG | SEQ ID NO: 397 |
| | | Probe | CACCTCCTCTCCAATGCCTGTGAA | SEQ ID NO: 398 |
| | | Reverse Primer | GGGCTATGGCAGAAACTCCT | SEQ ID NO: 399 |
| Cdx2 | NM_001265.2 | Forward Primer | GGGCAGGCAAGGTTTACA | SEQ ID NO: 400 |
| | | Probe | ATCTTAGCTGCCTTTGGCTTCCGC | SEQ ID NO: 401 |
| | | Reverse Primer | GTCTTTGGTCAGTCCAGCTTTC | SEQ ID NO: 402 |

TABLE A-continued

| Gene | Accession | Reagent | Sequence | Sequence ID Number |
|---|---|---|---|---|
| CEACAM1 | NM_001712.2 | Forward Primer<br>Probe<br>Reverse Primer | ACTTGCCTGTTCAGAGCACTCA<br>TCCTTCCCACCCCCAGTCCTGTC<br>TGGCAAATCCGAATTAGAGTGA | SEQ ID NO: 403<br>SEQ ID NO: 404<br>SEQ ID NO: 405 |
| CEACAM6 | NM_002483.2 | Forward Primer<br>Probe<br>Reverse Primer | CACAGCCTCACTTCTAACCTTCTG<br>ACCCACCCACCACTGCCAAGCTC<br>TTGAATGGCGTGGATTCAATAG | SEQ ID NO: 406<br>SEQ ID NO: 407<br>SEQ ID NO: 408 |
| CEBPB | NM_005194.2 | Forward Primer<br>Probe<br>Reverse Primer | GCAACCCACGTGTAACTGTC<br>CCGGGCCCTGAGTAATCGCTTAA<br>ACAAGCCCGTAGGAACATCT | SEQ ID NO: 409<br>SEQ ID NO: 410<br>SEQ ID NO: 411 |
| CEGP1 | NM_020974.1 | Forward Primer<br>Probe<br>Reverse Primer | TGACAATCAGCACACCTGCAT<br>CAGGCCCTCTTCCGAGCGGT<br>TGTGACTACAGCCGTGATCCTTA | SEQ ID NO: 412<br>SEQ ID NO: 413<br>SEQ ID NO: 414 |
| CENPA | NM_001809.2 | Forward Primer<br>Probe<br>Reverse Primer | TAAATTCACTCGTGGTGTGGA<br>CTTCAATTGGCAAGCCCAGGC<br>GCCTCTTGTAGGGCCAATAG | SEQ ID NO: 415<br>SEQ ID NO: 416<br>SEQ ID NO: 417 |
| CENPE | NM_001813.1 | Forward Primer<br>Probe<br>Reverse Primer | GGATGCTGGTGACCTCTTCT<br>TCCCTCACGTTGCAACAGGAATTAA<br>GCCAAGGCACCAAGTAACTC | SEQ ID NO: 418<br>SEQ ID NO: 419<br>SEQ ID NO: 420 |
| CENPF | NM_016343.2 | Forward Primer<br>Probe<br>Reverse Primer | CTCCCGTCAACAGCGTTC<br>ACACTGGACCAGGAGTGCATCCAG<br>GGGTGAGTCTGGCCTTCA | SEQ ID NO: 421<br>SEQ ID NO: 422<br>SEQ ID NO: 423 |
| CES2 | NM_003869.4 | Forward Primer<br>Probe<br>Reverse Primer | ACTTTGCGAGAAATGGGAAC<br>AGTGTGGCAGACCCTCGCCATT<br>CAGGTATTGCTCCTCCTGGT | SEQ ID NO: 424<br>SEQ ID NO: 425<br>SEQ ID NO: 426 |
| CGA (CHGA official) | NM_001275.2 | Forward Primer<br>Probe<br>Reverse Primer | CTGAAGGAGCTCCAAGACCT<br>TGCTGATGTGCCCTCTCCTTGG<br>CAAAACCGCTGTGTTTCTTC | SEQ ID NO: 427<br>SEQ ID NO: 428<br>SEQ ID NO: 429 |
| CGB | NM_000737.2 | Forward Primer<br>Probe<br>Reverse Primer | CCACCATAGGCAGAGGCA<br>ACACCCTACTCCCTGTGCCTCCAG<br>AGTCGTCGAGTGCTAGGGAC | SEQ ID NO: 430<br>SEQ ID NO: 431<br>SEQ ID NO: 432 |
| CHAF1B | NM_005441.1 | Forward Primer<br>Probe<br>Reverse Primer | GAGGCCAGTGGTGGAAACAG<br>AGCTGATGAGTCTGCCCTACCGCCTG<br>TCCGAGGCCACAGCAAAC | SEQ ID NO: 433<br>SEQ ID NO: 434<br>SEQ ID NO: 435 |
| CHD2 | NM_001271.1 | Forward Primer<br>Probe<br>Reverse Primer | CTCTGTGCGAGGCTGTCA<br>ACCCATCTCGGGATCCCTGATACC<br>GGTAAGGACTGTGGGCTGG | SEQ ID NO: 436<br>SEQ ID NO: 437<br>SEQ ID NO: 438 |
| CHFR | NM_018223.1 | Forward Primer<br>Probe<br>Reverse Primer | AAGGAAGTGGTCCCTCTGTG<br>TGAAGTCTCCAGCTTTGCCTCAGC<br>GACGCAGTCTTTCTGTCTGG | SEQ ID NO: 439<br>SEQ ID NO: 440<br>SEQ ID NO: 441 |
| Chk1 | NM_001274.1 | Forward Primer<br>Probe<br>Reverse Primer | GATAAATTGGTACAAGGGATCAGCTT<br>CCAGCCCACATGTCCTGATCATATGC<br>GGGTGCCAAGTAACTGACTATTCA | SEQ ID NO: 442<br>SEQ ID NO: 443<br>SEQ ID NO: 444 |
| Chk2 | NM_007194.1 | Forward Primer<br>Probe<br>Reverse Primer | ATGTGGAACCCCCACCTACTT<br>AGTCCCAACAGAAACAAGAACTTCAGGCG<br>CAGTCCACAGCACGGTTATACC | SEQ ID NO: 445<br>SEQ ID NO: 446<br>SEQ ID NO: 447 |
| CIAP1 | NM_001166.2 | Forward Primer<br>Probe<br>Reverse Primer | TGCCTGTGGTGGGAAGCT<br>TGACATAGCATCATCCTTTGGTTCCCAGTT<br>GGAAAATGCCTCCGGTGTT | SEQ ID NO: 448<br>SEQ ID NO: 449<br>SEQ ID NO: 450 |
| cIAP2 | NM_001165.2 | Forward Primer<br>Probe<br>Reverse Primer | GGATATTTCCGTGGCTCTTATTCA<br>TCTCCATCAAATCCTGTAAACTCCAGACA<br>CTTCTCATCAAGGCAGAAAAATCTT | SEQ ID NO: 451<br>SEQ ID NO: 452<br>SEQ ID NO: 453 |
| CKS1B | NM_001826.1 | Forward Primer<br>Probe<br>Reverse Primer | GGTCCCTAAAACCCATCTGA<br>TGAACGCCAAGATTCCTCCATTCA<br>TAATGGACCCATCCCTGACT | SEQ ID NO: 454<br>SEQ ID NO: 455<br>SEQ ID NO: 456 |
| CKS2 | NM_001827.1 | Forward Primer<br>Probe<br>Reverse Primer | GGCTGGACGTGGTTTTGTCT<br>CTGCGCCCGCTCTTCGCG<br>CGCTGCAGAAAATGAAACGA | SEQ ID NO: 457<br>SEQ ID NO: 458<br>SEQ ID NO: 459 |

TABLE A-continued

| Gene | Accession | Reagent | Sequence | Sequence ID Number |
|---|---|---|---|---|
| Claudin 4 | NM_001305.2 | Forward Primer | GGCTGCTTTGCTGCAACTG | SEQ ID NO: 460 |
| | | Probe | CGCACAGACAAGCCTTACTCCGCC | SEQ ID NO: 461 |
| | | Reverse Primer | CAGAGCGGGCAGCAGAATA | SEQ ID NO: 462 |
| CLDN1 | NM_021101.3 | Forward Primer | TCTGGGAGGTGCCCTACTT | SEQ ID NO: 463 |
| | | Probe | TGTTCCTGTCCCCGAAAAACAACC | SEQ ID NO: 464 |
| | | Reverse Primer | TGGATAGGGCCTTGGTGTT | SEQ ID NO: 465 |
| CLDN7 | NM_001307.3 | Forward Primer | GGTCTGCCCTAGTCATCCTG | SEQ ID NO: 466 |
| | | Probe | TGCACTGCTCTCCTGTTCCTGTCC | SEQ ID NO: 467 |
| | | Reverse Primer | GTACCCAGCCTTGCTCTCAT | SEQ ID NO: 468 |
| CLIC1 | NM_001288.3 | Forward Primer | CGGTACTTGAGCAATGCCTA | SEQ ID NO: 469 |
| | | Probe | CGGGAAGAATTCGCTTCCACCTG | SEQ ID NO: 470 |
| | | Reverse Primer | TCGATCTCCTCATCATCTGG | SEQ ID NO: 471 |
| CLTC | NM_004859.1 | Forward Primer | ACCGTATGGACAGCCACAG | SEQ ID NO: 472 |
| | | Probe | TCTCACATGCTGTACCCAAAGCCA | SEQ ID NO: 473 |
| | | Reverse Primer | TGACTACAGGATCAGCGCTTC | SEQ ID NO: 474 |
| CLU | NM_001831.1 | Forward Primer | CCCCAGGATACCTACCACTACCT | SEQ ID NO: 475 |
| | | Probe | CCCTTCAGCCTGCCCCACCG | SEQ ID NO: 476 |
| | | Reverse Primer | TGCGGGACTTGGGAAAGA | SEQ ID NO: 477 |
| cMet | NM_000245.1 | Forward Primer | GACATTTCCAGTCCTGCAGTCA | SEQ ID NO: 478 |
| | | Probe | TGCCTCTCTGCCCCACCCTTTGT | SEQ ID NO: 479 |
| | | Reverse Primer | CTCCGATCGCACACATTTGT | SEQ ID NO: 480 |
| cMYC | NM_002467.1 | Forward Primer | TCCCTCCACTCGGAAGGACTA | SEQ ID NO: 481 |
| | | Probe | TCTGACACTGTCCAACTTGACCCTCTT | SEQ ID NO: 482 |
| | | Reverse Primer | CGGTTGTTGCTGATCTGTCTCA | SEQ ID NO: 483 |
| CNN | NM_001299.2 | Forward Primer | TCCACCCTCCTGGCTTTG | SEQ ID NO: 484 |
| | | Probe | TCCTTTCGTCTTCGCCATGCTGG | SEQ ID NO: 485 |
| | | Reverse Primer | TCACTCCCACGTTCACCTTGT | SEQ ID NO: 486 |
| COL1A1 | NM_000088.2 | Forward Primer | GTGGCCATCCAGCTGACC | SEQ ID NO: 487 |
| | | Probe | TCCTGCGCCTGATGTCCACCG | SEQ ID NO: 488 |
| | | Reverse Primer | CAGTGGTAGGTGATGTTCTGGGA | SEQ ID NO: 489 |
| COL1A2 | NM_000089.2 | Forward Primer | CAGCCAAGAACTGGTATAGGAGCT | SEQ ID NO: 490 |
| | | Probe | TCTCCTAGCCAGACGTGTTTCTTGTCCTTG | SEQ ID NO: 491 |
| | | Reverse Primer | AAACTGGCTGCCAGCATTG | SEQ ID NO: 492 |
| COPS3 | NM_003653.2 | Forward Primer | ATGCCCAGTGTTCCTGACTT | SEQ ID NO: 493 |
| | | Probe | CGAAACGCTATTCTCACAGGTTCAGC | SEQ ID NO: 494 |
| | | Reverse Primer | CTCCCCATTACAAGTGCTGA | SEQ ID NO: 495 |
| COX2 | NM_000963.1 | Forward Primer | TCTGCAGAGTTGGAAGCACTCTA | SEQ ID NO: 496 |
| | | Probe | CAGGATACAGCTCCACAGCATCGATGTC | SEQ ID NO: 497 |
| | | Reverse Primer | GCCGAGGCTTTTCTACCAGAA | SEQ ID NO: 498 |
| COX3 | MITO_COX3 | Forward Primer | TCGAGTCTCCCTTCACCATT | SEQ ID NO: 499 |
| | | Probe | CGACGGCATCTACGGCTCAACAT | SEQ ID NO: 500 |
| | | Reverse Primer | GACGTGAAGTCCGTGGAAG | SEQ ID NO: 501 |
| CP | NM_000096.1 | Forward Primer | CGTGAGTACACAGATGCCTCC | SEQ ID NO: 502 |
| | | Probe | TCTTCAGGGCCTCTCTCCTTTCGA | SEQ ID NO: 503 |
| | | Reverse Primer | CCAGGATGCCAAGATGCT | SEQ ID NO: 504 |
| CRBP | NM_002899.2 | Forward Primer | TGGTCTGCAAGCAAGTATTCAAG | SEQ ID NO: 505 |
| | | Probe | TCTGCTTGGGCCTCACTGCACCT | SEQ ID NO: 506 |
| | | Reverse Primer | GCTGATTGGTTGGGACAAGGT | SEQ ID NO: 507 |
| CREBBP | NM_004380.1 | Forward Primer | TGGGAAGCAGCTGTGTACCAT | SEQ ID NO: 508 |
| | | Probe | CCTCGCGATGCTGCCTACTACAGCTATC | SEQ ID NO: 509 |
| | | Reverse Primer | GAAACACTTCTCACAGAAATGATACCTATT | SEQ ID NO: 510 |
| CRIP2 | NM_001312.1 | Forward Primer | GTGCTACGCCACCCTGTT | SEQ ID NO: 511 |
| | | Probe | CCGATGTTCACGCCTTTGGGTC | SEQ ID NO: 512 |
| | | Reverse Primer | CAGGGGCTTCTCGTAGATGT | SEQ ID NO: 513 |
| cripto (TDGF1 official) | NM_003212.1 | Forward Primer | GGGTCTGTGCCCCATGAC | SEQ ID NO: 514 |
| | | Probe | CCTGGCTGCCCAAGAAGTGTTCCCT | SEQ ID NO: 515 |
| | | Reverse Primer | TGACCGTGCCAGCATTTACA | SEQ ID NO: 516 |

TABLE A-continued

| Gene | Accession | Reagent | Sequence | Sequence ID Number |
|---|---|---|---|---|
| CRK(a) | NM_016823.2 | Forward Primer | CTCCCTAACCTCCAGAATGG | SEQ ID NO: 517 |
| | | Probe | ACTCGCTTCTGGATAACCCTGGCA | SEQ ID NO: 518 |
| | | Reverse Primer | TGTCTTGTCGTAGGCATTGG | SEQ ID NO: 519 |
| CRMP1 | NM_001313.1 | Forward Primer | AAGGTTTTTGGATTGCAAGG | SEQ ID NO: 520 |
| | | Probe | ACCGTCATACATGCCCTGGAAAC | SEQ ID NO: 521 |
| | | Reverse Primer | GGGTGTAGCTGGTACCTCGT | SEQ ID NO: 522 |
| CRYAB | NM_001885.1 | Forward Primer | GATGTGATTGAGGTGCATGG | SEQ ID NO: 523 |
| | | Probe | TGTTCATCCTGGCGCTCTTCATGT | SEQ ID NO: 524 |
| | | Reverse Primer | GAACTCCCTGGAGATGAAACC | SEQ ID NO: 525 |
| CSEL1 | NM_001316.2 | Forward Primer | TTACGCAGCTCATGCTCTTG | SEQ ID NO: 526 |
| | | Probe | ACGGCTCTTTACTATGCGAGGGCC | SEQ ID NO: 527 |
| | | Reverse Primer | GCAGCTGTAAAGAGAGTGGCAT | SEQ ID NO: 528 |
| CSF1 | NM_000757.3 | Forward Primer | TGCAGCGGCTGATTGACA | SEQ ID NO: 529 |
| | | Probe | TCAGATGGAGACCTCGTGCCAAATTACA | SEQ ID NO: 530 |
| | | Reverse Primer | CAACTGTTCCTGGTCTACAAACTCA | SEQ ID NO: 531 |
| CSK (SRC) | NM_004383.1 | Forward Primer | CCTGAACATGAAGGAGCTGA | SEQ ID NO: 532 |
| | | Probe | TCCCGATGGTCTGCAGCAGCT | SEQ ID NO: 533 |
| | | Reverse Primer | CATCACGTCTCCGAACTCC | SEQ ID NO: 534 |
| CTAG1B | NM_001327.1 | Forward Primer | GCTCTCCATCAGCTCCTGTC | SEQ ID NO: 535 |
| | | Probe | CCACATCAACAGGGAAAGCTGCTG | SEQ ID NO: 536 |
| | | Reverse Primer | AACACGGGCAGAAAGCACT | SEQ ID NO: 537 |
| CTGF | NM_001901.1 | Forward Primer | GAGTTCAAGTGCCCTGACG | SEQ ID NO: 538 |
| | | Probe | AACATCATGTTCTTCTTCATGACCTCGC | SEQ ID NO: 539 |
| | | Reverse Primer | AGTTGTAATGGCAGGCACAG | SEQ ID NO: 540 |
| CTHRC1 | NM_138455.2 | Forward Primer | GCTCACTTCGGCTAAAATGC | SEQ ID NO: 541 |
| | | Probe | ACCAACGCTGACAGCATGCATTTC | SEQ ID NO: 542 |
| | | Reverse Primer | TCAGCTCCATTGAATGTGAAA | SEQ ID NO: 543 |
| CTLA4 | NM_005214.2 | Forward Primer | CACTGAGGTCCGGGTGACA | SEQ ID NO: 544 |
| | | Probe | CACCTGGCTGTCAGCCTGCCG | SEQ ID NO: 545 |
| | | Reverse Primer | GTAGGTTGCCGCACAGACTTC | SEQ ID NO: 546 |
| CTNNBIP1 | NM_020248.2 | Forward Primer | GTTTTCCAGGTCGGAGACG | SEQ ID NO: 547 |
| | | Probe | CTTTGCAGCTACTGCCTCCGGTCT | SEQ ID NO: 548 |
| | | Reverse Primer | AGCATCCAGGGTGTTCCA | SEQ ID NO: 549 |
| CTSB | NM_001908.1 | Forward Primer | GGCCGAGATCTACAAAAACG | SEQ ID NO: 550 |
| | | Probe | CCCCGTGGAGGGAGCTTTCTC | SEQ ID NO: 551 |
| | | Reverse Primer | GCAGGAAGTCCGAATACACA | SEQ ID NO: 552 |
| CTSD | NM_001909.1 | Forward Primer | GTACATGATCCCCTGTGAGAAGGT | SEQ ID NO: 553 |
| | | Probe | ACCCTGCCCGCGATCACACTGA | SEQ ID NO: 554 |
| | | Reverse Primer | GGGACAGCTTGTAGCCTTTGC | SEQ ID NO: 555 |
| CTSH | NM_004390.1 | Forward Primer | GCAAGTTCCAACCTGGAAAG | SEQ ID NO: 556 |
| | | Probe | TGGCTACATCCTTGACAAAGCCGA | SEQ ID NO: 557 |
| | | Reverse Primer | CATCGCTTCCTCGTCATAGA | SEQ ID NO: 558 |
| CTSL | NM_001912.1 | Forward Primer | GGGAGGCTTATCTCACTGAGTGA | SEQ ID NO: 559 |
| | | Probe | TTGAGGCCCAGAGCAGTCTACCAGATTCT | SEQ ID NO: 560 |
| | | Reverse Primer | CCATTGCAGCCTTCATTGC | SEQ ID NO: 561 |
| CTSL2 | NM_001333.2 | Forward Primer | TGTCTCACTGAGCGAGCAGAA | SEQ ID NO: 562 |
| | | Probe | CTTGAGGACGCGAACAGTCCACCA | SEQ ID NO: 563 |
| | | Reverse Primer | ACCATTGCAGCCCTGATTG | SEQ ID NO: 564 |
| CUL1 | NM_003592.2 | Forward Primer | ATGCCCTGGTAATGTCTGCAT | SEQ ID NO: 565 |
| | | Probe | CAGCCACAAAGCCAGCGTCATTGT | SEQ ID NO: 566 |
| | | Reverse Primer | GCGACCACAAGCCTTATCAAG | SEQ ID NO: 567 |
| CUL4A | NM_003589.1 | Forward Primer | AAGCATCTTCCTGTTCTTGGA | SEQ ID NO: 568 |
| | | Probe | TATGTGCTGCAGAACTCCACGCTG | SEQ ID NO: 569 |
| | | Reverse Primer | AATCCCATATCCCAGATGGA | SEQ ID NO: 570 |
| CXCL12 | NM_000609.3 | Forward Primer | GAGCTACAGATGCCCATGC | SEQ ID NO: 571 |
| | | Probe | TTCTTCGAAAGCCATGTTGCCAGA | SEQ ID NO: 572 |
| | | Reverse Primer | TTTGAGATGCTTGACGTTGG | SEQ ID NO: 573 |

TABLE A-continued

| Gene | Accession | Reagent | Sequence | Sequence ID Number |
|---|---|---|---|---|
| CXCR4 | NM_003467.1 | Forward Primer | TGACCGCTTCTACCCCAATG | SEQ ID NO: 574 |
| | | Probe | CTGAAACTGGAACACAACCACCCACAAG | SEQ ID NO: 575 |
| | | Reverse Primer | AGGATAAGGCCAACCATGATGT | SEQ ID NO: 576 |
| CYBA | NM_000101.1 | Forward Primer | GGTGCCTACTCCATTGTGG | SEQ ID NO: 577 |
| | | Probe | TACTCCAGCAGGCACACAAACACG | SEQ ID NO: 578 |
| | | Reverse Primer | GTGGAGCCCTTCTTCCTCTT | SEQ ID NO: 579 |
| CYP1B1 | NM_000104.2 | Forward Primer | CCAGCTTTGTGCCTGTCACTAT | SEQ ID NO: 580 |
| | | Probe | CTCATGCCACCACTGCCAACACCTC | SEQ ID NO: 581 |
| | | Reverse Primer | GGGAATGTGGTAGCCCAAGA | SEQ ID NO: 582 |
| CYP2C8 | NM_000770.2 | Forward Primer | CCGTGTTCAAGAGGAAGCTC | SEQ ID NO: 583 |
| | | Probe | TTTTCTCAACTCCTCCACAAGGCA | SEQ ID NO: 584 |
| | | Reverse Primer | AGTGGGATCACAGGGTGAAG | SEQ ID NO: 585 |
| CYP3A4 | NM_017460.3 | Forward Primer | AGAACAAGGACAACATAGATCCTTACATAT | SEQ ID NO: 586 |
| | | Probe | CACACCCTTTGGAAGTGGACCCAGAA | SEQ ID NO: 587 |
| | | Reverse Primer | GCAAACCTCATGCCAATGC | SEQ ID NO: 588 |
| CYR61 | NM_001554.3 | Forward Primer | TGCTCATTCTTGAGGAGCAT | SEQ ID NO: 589 |
| | | Probe | CAGCACCCTTGGCAGTTTCGAAAT | SEQ ID NO: 590 |
| | | Reverse Primer | GTGGCTGCATTAGTGTCCAT | SEQ ID NO: 591 |
| DAPK1 | NM_004938.1 | Forward Primer | CGCTGACATCATGAATGTTCCT | SEQ ID NO: 592 |
| | | Probe | TCATATCCAAACTCGCCTCCAGCCG | SEQ ID NO: 593 |
| | | Reverse Primer | TCTCTTTCAGCAACGATGTGTCTT | SEQ ID NO: 594 |
| DCC | NM_005215.1 | Forward Primer | AAATGTCCTCCTCGACTGCT | SEQ ID NO: 595 |
| | | Probe | ATCACTGGAACTCCTCGGTCGGAC | SEQ ID NO: 596 |
| | | Reverse Primer | TGAATGCCATCTTTCTTCCA | SEQ ID NO: 597 |
| DCC_exons18-23 | X76132_18-23 | Forward Primer | GGTCACCGTTGGTGTCATCA | SEQ ID NO: 598 |
| | | Probe | CAGCCACGATGACCACTACCAGCACT | SEQ ID NO: 599 |
| | | Reverse Primer | GAGCGTCGGGTGCAAATC | SEQ ID NO: 600 |
| DCC_exons6-7 | X76132_6-7 | Forward Primer | ATGGAGATGTGGTCATTCCTAGTG | SEQ ID NO: 601 |
| | | Probe | TGCTTCCTCCCACTATCTGAAAATAA | SEQ ID NO: 602 |
| | | Reverse Primer | CACCACCCCAAGTATCCGTAAG | SEQ ID NO: 603 |
| DCK | NM_000788.1 | Forward Primer | GCCGCCACAAGACTAAGGAAT | SEQ ID NO: 604 |
| | | Probe | AGCTGCCCGTCTTTCTCAGCCAGC | SEQ ID NO: 605 |
| | | Reverse Primer | CGATGTTCCCTTCGATGGAG | SEQ ID NO: 606 |
| DDB1 | NM_001923.2 | Forward Primer | TGCGGATCATCCGGAATG | SEQ ID NO: 607 |
| | | Probe | AATTGGAATCCACGAGCATGCCAGC | SEQ ID NO: 608 |
| | | Reverse Primer | TCCTTTGATGCCTGGTAAGTCA | SEQ ID NO: 609 |
| DET1 | NM_017996.2 | Forward Primer | CTTGTGGAGATCACCCAATCAG | SEQ ID NO: 610 |
| | | Probe | CTATGCCCGGGACTCGGGCCT | SEQ ID NO: 611 |
| | | Reverse Primer | CCCGCCTGGATCTCAAACT | SEQ ID NO: 612 |
| DHFR | NM_000791.2 | Forward Primer | TTGCTATAACTAAGTGCTTCTCCAAGA | SEQ ID NO: 613 |
| | | Probe | CCCAACTGAGTCCCCAGCACCT | SEQ ID NO: 614 |
| | | Reverse Primer | GTGGAATGGCAGCTCACTGTAG | SEQ ID NO: 615 |
| DHPS | NM_013407.1 | Forward Primer | GGGAGAACGGGATCAATAGGAT | SEQ ID NO: 616 |
| | | Probe | CTCATTGGGCACCAGCAGGTTTCC | SEQ ID NO: 617 |
| | | Reverse Primer | GCATCAGCCAGTCCTCAAACT | SEQ ID NO: 618 |
| DIABLO | NM_019887.1 | Forward Primer | CACAATGGCGGCTCTGAAG | SEQ ID NO: 619 |
| | | Probe | AAGTTACGCTGCGCGACAGCCAA | SEQ ID NO: 620 |
| | | Reverse Primer | ACACAAACACTGTCTGTACCTGAAGA | SEQ ID NO: 621 |
| DIAPH1 | NM_005219.2 | Forward Primer | CAAGCAGTCAAGGAGAACCA | SEQ ID NO: 622 |
| | | Probe | TTCTTCTGTCTCCCGCCGCTTC | SEQ ID NO: 623 |
| | | Reverse Primer | AGTTTTGCTCGCCTCATCTT | SEQ ID NO: 624 |
| DICER1 | NM_177438.1 | Forward Primer | TCCAATTCCAGCATCACTGT | SEQ ID NO: 625 |
| | | Probe | AGAAAGCTGTTTGTCTCCCCAGCA | SEQ ID NO: 626 |
| | | Reverse Primer | GGCAGTGAAGGCGATAAAGT | SEQ ID NO: 627 |
| DKK1 | NM_012242.1 | Forward Primer | TGACAACTACCAGCCGTACC | SEQ ID NO: 628 |
| | | Probe | AGTGCCGCACTCCTCGTCCTCT | SEQ ID NO: 629 |
| | | Reverse Primer | GGGACTAGCGCAGTACTCATC | SEQ ID NO: 630 |

TABLE A-continued

| Gene | Accession | Reagent | Sequence | Sequence ID Number |
|---|---|---|---|---|
| DLC1 | NM_006094.3 | Forward Primer<br>Probe<br>Reverse Primer | GATTCAGACGAGGATGAGCC<br>AAAGTCCATTTGCCACTGATGGCA<br>CACCTCTTGCTGTCCCTTTG | SEQ ID NO: 631<br>SEQ ID NO: 632<br>SEQ ID NO: 633 |
| DPYD | NM_000110.2 | Forward Primer<br>Probe<br>Reverse Primer | AGGACGCAAGGAGGGTTTG<br>CAGTGCCTACAGTCTCGAGTCTGCCAGTG<br>GATGTCCGCCGAGTCCTTACT | SEQ ID NO: 634<br>SEQ ID NO: 635<br>SEQ ID NO: 636 |
| DR4 | NM_003844.1 | Forward Primer<br>Probe<br>Reverse Primer | TGCACAGAGGGTGTGGGTTAC<br>CAATGCTTCCAACAATTTGTTTGCTTGCC<br>TCTTCATCTGATTTACAAGCTGTACATG | SEQ ID NO: 637<br>SEQ ID NO: 638<br>SEQ ID NO: 639 |
| DR5 | NM_003842.2 | Forward Primer<br>Probe<br>Reverse Primer | CTCTGAGACAGTGCTTCGATGACT<br>CAGACTTGGTGCCCTTTGACTCC<br>CCATGAGGCCCAACTTCCT | SEQ ID NO: 640<br>SEQ ID NO: 641<br>SEQ ID NO: 642 |
| DRG1 | NM_004147.3 | Forward Primer<br>Probe<br>Reverse Primer | CCTGGATCTCCCAGGTATCA<br>ACCTTTCCCATCCTTGGCACCTTC<br>TGCAATGACTTGACGACCTC | SEQ ID NO: 643<br>SEQ ID NO: 644<br>SEQ ID NO: 645 |
| DSP | NM_004415.1 | Forward Primer<br>Probe<br>Reverse Primer | TGGCACTACTGCATGATTGACA<br>CAGGGCCATGACAATCGCCAA<br>CCTGCCGCATTGTTTTCAG | SEQ ID NO: 646<br>SEQ ID NO: 647<br>SEQ ID NO: 648 |
| DTYMK | NM_012145.1 | Forward Primer<br>Probe<br>Reverse Primer | AAATCGCTGGGAACAAGTG<br>CGCCCTGGCTCAACTTTTCCTTAA<br>AATGCGTATCTGTCCACGAC | SEQ ID NO: 649<br>SEQ ID NO: 650<br>SEQ ID NO: 651 |
| DUSP1 | NM_004417.2 | Forward Primer<br>Probe<br>Reverse Primer | AGACATCAGCTCCTGGTTCA<br>CGAGGCCATTGACTTCATAGACTCCA<br>GACAAACACCCTTCCTCCAG | SEQ ID NO: 652<br>SEQ ID NO: 653<br>SEQ ID NO: 654 |
| DUSP2 | NM_004418.2 | Forward Primer<br>Probe<br>Reverse Primer | TATCCCTGTGGAGGACAACC<br>CCTCCTGGAACCAGGCACTGATCT<br>CACCCAGTCAATGAAGCCTA | SEQ ID NO: 655<br>SEQ ID NO: 656<br>SEQ ID NO: 657 |
| DUT | NM_001948.2 | Forward Primer<br>Probe<br>Reverse Primer | ACACATGGAGTGCTTCTGGA<br>ATCAGCCCACTTGACCACCCAGTT<br>CTCTTGCCTGTGCTTCCAC | SEQ ID NO: 658<br>SEQ ID NO: 659<br>SEQ ID NO: 660 |
| DYRK1B | NM_004714.1 | Forward Primer<br>Probe<br>Reverse Primer | AGCATGACACGGAGATGAAG<br>CACCTGAAGCGGCACTTCATGTTC<br>AATACCAGGCACAGGTGGTT | SEQ ID NO: 661<br>SEQ ID NO: 662<br>SEQ ID NO: 663 |
| E2F1 | NM_005225.1 | Forward Primer<br>Probe<br>Reverse Primer | ACTCCCTCTACCCTTGAGCA<br>CAGAAGAACAGCTCAGGGACCCCT<br>CAGGGCCTCAGTTCCTTCAGT | SEQ ID NO: 664<br>SEQ ID NO: 665<br>SEQ ID NO: 666 |
| EDN1<br>endothelin | NM_001955.1 | Forward Primer<br>Probe<br>Reverse Primer | TGCCACCTGGACATCATTTG<br>CACTCCCGAGCACGTTGTTCCGT<br>TGGACCTAGGGCTTCCAAGTC | SEQ ID NO: 667<br>SEQ ID NO: 668<br>SEQ ID NO: 669 |
| EFNA1 | NM_004428.2 | Forward Primer<br>Probe<br>Reverse Primer | TACATCTCCAAACCCATCCA<br>CAACCTCAAGCAGCGGTCTTCATG<br>TTGCCACTGACAGTCACCTT | SEQ ID NO: 670<br>SEQ ID NO: 671<br>SEQ ID NO: 672 |
| EFNA3 | NM_004952.3 | Forward Primer<br>Probe<br>Reverse Primer | ACTACATCTCCACGCCCACT<br>CCTCAGACACTTCCAGTGCAGGTTG<br>CAGCAGACGAACACCTTCAT | SEQ ID NO: 673<br>SEQ ID NO: 674<br>SEQ ID NO: 675 |
| EFNB1 | NM_004429.3 | Forward Primer<br>Probe<br>Reverse Primer | GGAGCCCGTATCCTGGAG<br>CCCTCAACCCAAGTTCCTGAGTG<br>GGATAGATCACCAAGCCCTTC | SEQ ID NO: 676<br>SEQ ID NO: 677<br>SEQ ID NO: 678 |
| EFNB2 | NM_004093.2 | Forward Primer<br>Probe<br>Reverse Primer | TGACATTATCATCCCGCTAAGGA<br>CGGACAGCGTCTTCTGCCCTCACT<br>GTAGTCCCCGCTGACCTTCTC | SEQ ID NO: 679<br>SEQ ID NO: 680<br>SEQ ID NO: 681 |
| EFP | NM_005082.2 | Forward Primer<br>Probe<br>Reverse Primer | TTGAACAGAGCCTGACCAAG<br>TGATGCTTTCTCCAGAAACTCGAACTCA<br>TGTTGAGATTCCTCGCAGTT | SEQ ID NO: 682<br>SEQ ID NO: 683<br>SEQ ID NO: 684 |
| EGFR | NM_005228.1 | Forward Primer<br>Probe<br>Reverse Primer | TGTCGATGGACTTCCAGAAC<br>CACCTGGGCAGCTGCCAA<br>ATTGGGACAGCTTGGATCA | SEQ ID NO: 685<br>SEQ ID NO: 686<br>SEQ ID NO: 687 |

TABLE A-continued

| Gene | Accession | Reagent | Sequence | Sequence ID Number |
|---|---|---|---|---|
| EGLN1 | NM_022051.1 | Forward Primer<br>Probe<br>Reverse Primer | TCAATGGCCGGACGAAAG<br>CATTGCCCGGATAACAAGCAACCATG<br>TTTGGATTATCAACATGACGTACATAAC | SEQ ID NO: 688<br>SEQ ID NO: 689<br>SEQ ID NO: 690 |
| EGLN3 | NM_022073.2 | Forward Primer<br>Probe<br>Reverse Primer | GCTGGTCCTCTACTGCGG<br>CCGGCTGGGCAAATACTACGTCAA<br>CCACCATTGCCTTAGACCTC | SEQ ID NO: 691<br>SEQ ID NO: 692<br>SEQ ID NO: 693 |
| EGR1 | NM_001964.2 | Forward Primer<br>Probe<br>Reverse Primer | GTCCCCGCTGCAGATCTCT<br>CGGATCCTTTCCTCACTCGCCCA<br>CTCCAGCTTAGGGTAGTTGTCCAT | SEQ ID NO: 694<br>SEQ ID NO: 695<br>SEQ ID NO: 696 |
| EGR3 | NM_004430.2 | Forward Primer<br>Probe<br>Reverse Primer | CCATGTGGATGAATGAGGTG<br>ACCCAGTCTCACCTTCTCCCCACC<br>TGCCTGAGAAGAGGTGAGGT | SEQ ID NO: 697<br>SEQ ID NO: 698<br>SEQ ID NO: 699 |
| EI24 | NM_004879.2 | Forward Primer<br>Probe<br>Reverse Primer | AAAGTGGTGAATGCCATTTG<br>CCTCAAATGCCAGGTCAGCTATATCCTG<br>GTGAGGCTTCCTCCCTGATA | SEQ ID NO: 700<br>SEQ ID NO: 701<br>SEQ ID NO: 702 |
| EIF4E | NM_001968.1 | Forward Primer<br>Probe<br>Reverse Primer | GATCTAAGATGGCGACTGTCGAA<br>ACCACCCCTACTCCTAATCCCCCGACT<br>TTAGATTCCGTTTTCTCCTCTTCTG | SEQ ID NO: 703<br>SEQ ID NO: 704<br>SEQ ID NO: 705 |
| EIF4EL3 | NM_004846.1 | Forward Primer<br>Probe<br>Reverse Primer | AAGCCGCGGTTGAATGTG<br>TGACCCTCTCCCTCTCTGGATGGCA<br>TGACGCCAGCTTCAATGATG | SEQ ID NO: 706<br>SEQ ID NO: 707<br>SEQ ID NO: 708 |
| ELAVL1 | NM_001419.2 | Forward Primer<br>Probe<br>Reverse Primer | GACAGGAGGCCTCTATCCTG<br>CACCCCACCCTCCACCTCAATC<br>GTGAGGTAGGTCTGGGGAAG | SEQ ID NO: 709<br>SEQ ID NO: 710<br>SEQ ID NO: 711 |
| EMP1 | NM_001423.1 | Forward Primer<br>Probe<br>Reverse Primer | GCTAGTACTTTGATGCTCCCTTGAT<br>CCAGAGAGCCTCCCTGCAGCCA<br>GAACAGCTGGAGGCCAAGTC | SEQ ID NO: 712<br>SEQ ID NO: 713<br>SEQ ID NO: 714 |
| EMR3 | NM_032571.2 | Forward Primer<br>Probe<br>Reverse Primer | TGGCCTACCTCTTCACCATC<br>TCAACAGCCTCCAAGGCTTCTTCA<br>TGAGGAGGCAGTAGACCAAGA | SEQ ID NO: 715<br>SEQ ID NO: 716<br>SEQ ID NO: 717 |
| EMS1 | NM_005231.2 | Forward Primer<br>Probe<br>Reverse Primer | GGCAGTGTCACTGAGTCCTTGA<br>ATCCTCCCTGCCCCGCG<br>TGCACTGTGCGTCCCAAT | SEQ ID NO: 718<br>SEQ ID NO: 719<br>SEQ ID NO: 720 |
| ENO1 | NM_001428.2 | Forward Primer<br>Probe<br>Reverse Primer | CAAGGCCGTGAACGAGAAGT<br>CTGCAACTGCCTCCTGCTCAAAGTCA<br>CGGTCACGGAGCCAATCT | SEQ ID NO: 721<br>SEQ ID NO: 722<br>SEQ ID NO: 723 |
| EP300 | NM_001429.1 | Forward Primer<br>Probe<br>Reverse Primer | AGCCCCAGCAACTACAGTCT<br>CACTGACATCATGGCTGGCCTTG<br>TGTTCAAAGGTTGACCATGC | SEQ ID NO: 724<br>SEQ ID NO: 725<br>SEQ ID NO: 726 |
| EPAS1 | NM_001430.3 | Forward Primer<br>Probe<br>Reverse Primer | AAGCCTTGGAGGGTTTCATTG<br>TGTCGCCATCTTGGGTCACCACG<br>TGCTGATGTTTTCTGACAGAAAGAT | SEQ ID NO: 727<br>SEQ ID NO: 728<br>SEQ ID NO: 729 |
| EpCAM | NM_002354.1 | Forward Primer<br>Probe<br>Reverse Primer | GGGCCCTCCAGAACAATGAT<br>CCGCTCTCATCGCAGTCAGGATCAT<br>TGCACTGCTTGGCCTTAAAGA | SEQ ID NO: 730<br>SEQ ID NO: 731<br>SEQ ID NO: 732 |
| EPHA2 | NM_004431.2 | Forward Primer<br>Probe<br>Reverse Primer | CGCCTGTTCACCAAGATTGAC<br>TGCGCCCGATGAGATCACCG<br>GTGGCGTGCCTCGAAGTC | SEQ ID NO: 733<br>SEQ ID NO: 734<br>SEQ ID NO: 735 |
| EPHB2 | NM_004442.4 | Forward Primer<br>Probe<br>Reverse Primer | CAACCAGGCAGCTCCATC<br>CACCTGATGCATGATGGACACTGC<br>GTAATGCTGTCCACGGTGC | SEQ ID NO: 736<br>SEQ ID NO: 737<br>SEQ ID NO: 738 |
| EPHB4 | NM_004444.3 | Forward Primer<br>Probe<br>Reverse Primer | TGAACGGGGTATCCTCCTTA<br>CGTCCCATTTGAGCCTGTCAATGT<br>AGGTACCTCTCGGTCAGTGG | SEQ ID NO: 739<br>SEQ ID NO: 740<br>SEQ ID NO: 741 |
| EphB6 | NM_004445.1 | Forward Primer<br>Probe<br>Reverse Primer | ACTGGTCCTCCATCGGCT<br>CCTTGCACCTCAAACCAAAGCTCC<br>CCAGTGTAGCATGAGTGCTGA | SEQ ID NO: 742<br>SEQ ID NO: 743<br>SEQ ID NO: 744 |

TABLE A-continued

| Gene | Accession | Reagent | Sequence | Sequence ID Number |
|---|---|---|---|---|
| EPM2A | NM_005670.2 | Forward Primer<br>Probe<br>Reverse Primer | ACTGTGGCACTTAGGGGAGA<br>CTGCCTCTGCCCAAAGCAAATGTC<br>AGTGGAAATGTGTCCTGGCT | SEQ ID NO: 745<br>SEQ ID NO: 746<br>SEQ ID NO: 747 |
| ErbB3 | NM_001982.1 | Forward Primer<br>Probe<br>Reverse Primer | CGGTTATGTCATGCCAGATACAC<br>CCTCAAAGGTACTCCCTCCTCCCGG<br>GAACTGAGACCCACTGAAGAAAGG | SEQ ID NO: 748<br>SEQ ID NO: 749<br>SEQ ID NO: 750 |
| ERCC1 | NM_001983.1 | Forward Primer<br>Probe<br>Reverse Primer | GTCCAGGTGGATGTGAAAGA<br>CAGCAGGCCCTCAAGGAGCTG<br>CGGCCAGGATACACATCTTA | SEQ ID NO: 751<br>SEQ ID NO: 752<br>SEQ ID NO: 753 |
| ERCC2 | NM_000400.2 | Forward Primer<br>Probe<br>Reverse Primer | TGGCCTTCTTCACCAGCTA<br>AGGCCACGGTGCTCTCCATGTACT<br>CAAGGATCCCCTGCTCATAC | SEQ ID NO: 754<br>SEQ ID NO: 755<br>SEQ ID NO: 756 |
| EREG | NM_001432.1 | Forward Primer<br>Probe<br>Reverse Primer | ATAACAAAGTGTAGCTCTGACATGAATG<br>TTGTTTGCATGGACAGTGCATCTATCTGGT<br>CACACCTGCAGTAGTTTTGACTCA | SEQ ID NO: 757<br>SEQ ID NO: 758<br>SEQ ID NO: 759 |
| ERK1 | Z11696.1 | Forward Primer<br>Probe<br>Reverse Primer | ACGGATCACAGTGGAGGAAG<br>CGCTGGCTCACCCCTACCTG<br>CTCATCCGTCGGGTCATAGT | SEQ ID NO: 760<br>SEQ ID NO: 761<br>SEQ ID NO: 762 |
| ERK2 | NM_002745.1 | Forward Primer<br>Probe<br>Reverse Primer | AGTTCTTGACCCCTGGTCCT<br>TCTCCAGCCCGTCTTGGCTT<br>AAACGGCTCAAAGGAGTCAA | SEQ ID NO: 763<br>SEQ ID NO: 764<br>SEQ ID NO: 765 |
| ESPL1 | NM_012291.1 | Forward Primer<br>Probe<br>Reverse Primer | ACCCCCAGACCGGATCAG<br>CTGGCCCTCATGTCCCCTTCACG<br>TGTAGGGCAGACTTCCTCAAACA | SEQ ID NO: 766<br>SEQ ID NO: 767<br>SEQ ID NO: 768 |
| EstR1 | NM_000125.1 | Forward Primer<br>Probe<br>Reverse Primer | CGTGGTGCCCCTCTATGAC<br>CTGGAGATGCTGGACGCCC<br>GGCTAGTGGGCGCATGTAG | SEQ ID NO: 769<br>SEQ ID NO: 770<br>SEQ ID NO: 771 |
| ETV4 | NM_001986.1 | Forward Primer<br>Probe<br>Reverse Primer | TCCAGTGCCTATGACCCC<br>CAGACAAATCGCCATCAAGTCCCC<br>ACTGTCCAAGGGCACCAG | SEQ ID NO: 772<br>SEQ ID NO: 773<br>SEQ ID NO: 774 |
| F3 | NM_001993.2 | Forward Primer<br>Probe<br>Reverse Primer | GTGAAGGATGTGAAGCAGACGTA<br>TGGCACGGGTCTTCTCCTACC<br>AACCGGTGCTCTCCACATTC | SEQ ID NO: 775<br>SEQ ID NO: 776<br>SEQ ID NO: 777 |
| FABP4 | NM_001442.1 | Forward Primer<br>Probe<br>Reverse Primer | GCTTTGCCACCAGGAAAGT<br>CTGGCATGGCCAAACCTAACATGA<br>CATCCCCATTCACACTGATG | SEQ ID NO: 778<br>SEQ ID NO: 779<br>SEQ ID NO: 780 |
| FAP | NM_004460.2 | Forward Primer<br>Probe<br>Reverse Primer | CTGACCAGAACCACGGCT<br>CGGCCTGTCCACGAACCACTTATA<br>GGAAGTGGGTCATGTGGG | SEQ ID NO: 781<br>SEQ ID NO: 782<br>SEQ ID NO: 783 |
| fas | NM_000043.1 | Forward Primer<br>Probe<br>Reverse Primer | GGATTGCTCAACAACCATGCT<br>TCTGGACCCTCCTACCTCTGGTTCTTACGT<br>GGCATTAACACTTTTGGACGATAA | SEQ ID NO: 784<br>SEQ ID NO: 785<br>SEQ ID NO: 786 |
| fasl | NM_000639.1 | Forward Primer<br>Probe<br>Reverse Primer | GCACTTTGGGATTCTTTCCATTAT<br>ACAACATTCTCGGTGCCTGTAACAAAGAA<br>GCATGTAAGAAGACCCTCACTGAA | SEQ ID NO: 787<br>SEQ ID NO: 788<br>SEQ ID NO: 789 |
| FASN | NM_004104.4 | Forward Primer<br>Probe<br>Reverse Primer | GCCTCTTCCTGTTCGACG<br>TCGCCCACCTACGTACTGGCCTAC<br>GCTTTGCCCGGTAGCTCT | SEQ ID NO: 790<br>SEQ ID NO: 791<br>SEQ ID NO: 792 |
| FBXO5 | NM_012177.2 | Forward Primer<br>Probe<br>Reverse Primer | GGCTATTCCTCATTTTCTCTACAAAGTG<br>CCTCCAGGAGGCTACCTTCTTCATGTTCAC<br>GGATTGTAGACTGTCACCGAAATTC | SEQ ID NO: 793<br>SEQ ID NO: 794<br>SEQ ID NO: 795 |
| FBXW7 | NM_033632.1 | Forward Primer<br>Probe<br>Reverse Primer | CCCCAGTTTCAACGAGACTT<br>TCATTGCTCCCTAAAGAGTTGGCACTC<br>GTTCCAGGAATGAAAGCACA | SEQ ID NO: 796<br>SEQ ID NO: 797<br>SEQ ID NO: 798 |
| FDXR | NM_004110.2 | Forward Primer<br>Probe<br>Reverse Primer | GAGATGATTCAGTTACCGGGAG<br>AATCCACAGGATCCAAAATGGGCC<br>ATCTTGTCCTGGAGACCCAA | SEQ ID NO: 799<br>SEQ ID NO: 800<br>SEQ ID NO: 801 |

TABLE A-continued

| Gene | Accession | Reagent | Sequence | Sequence ID Number |
|---|---|---|---|---|
| FES | NM_002005.2 | Forward Primer<br>Probe<br>Reverse Primer | CTCTGCAGGCCTAGGTGC<br>CTCCTCAGCGGCTCCAGCTCATAT<br>CCAGGACTGTGAAGAGCTGTC | SEQ ID NO: 802<br>SEQ ID NO: 803<br>SEQ ID NO: 804 |
| FGF18 | NM_003862.1 | Forward Primer<br>Probe<br>Reverse Primer | CGGTAGTCAAGTCCGGATCAA<br>CAAGGAGACGGAATTCTACCTGTGC<br>GCTTGCCTTTGCGGTTCA | SEQ ID NO: 805<br>SEQ ID NO: 806<br>SEQ ID NO: 807 |
| FGF2 | NM_002006.2 | Forward Primer<br>Probe<br>Reverse Primer | AGATGCAGGAGAGAGGAAGC<br>CCTGCAGACTGCTTTTTGCCCAAT<br>GTTTTGCAGCCTTACCCAAT | SEQ ID NO: 808<br>SEQ ID NO: 809<br>SEQ ID NO: 810 |
| FGFR1 | NM_023109.1 | Forward Primer<br>Probe<br>Reverse Primer | CACGGGACATTCACCACATC<br>ATAAAAAGACAACCAACGGCCGACTGC<br>GGGTGCCATCCACTTCACA | SEQ ID NO: 811<br>SEQ ID NO: 812<br>SEQ ID NO: 813 |
| FGFR2 isoform 1 | NM_000141.2 | Forward Primer<br>Probe<br>Reverse Primer | GAGGGACTGTTGGCATGCA<br>TCCCAGAGACCAACGTTCAAGCAGTTG<br>GAGTGAGAATTCGATCCAAGTCTTC | SEQ ID NO: 814<br>SEQ ID NO: 815<br>SEQ ID NO: 816 |
| FHIT | NM_002012.1 | Forward Primer<br>Probe<br>Reverse Primer | CCAGTGGAGCGCTTCCAT<br>TCGGCCACTTCATCAGGACGCAG<br>CTCTCTGGGTCGTCTGAAACAA | SEQ ID NO: 817<br>SEQ ID NO: 818<br>SEQ ID NO: 819 |
| FIGF | NM_004469.2 | Forward Primer<br>Probe<br>Reverse Primer | GGTTCCAGCTTTCTGTAGCTGT<br>ATTGGTGGCCACACCACCTCCTTA<br>GCCGCAGGTTCTAGTTGCT | SEQ ID NO: 820<br>SEQ ID NO: 821<br>SEQ ID NO: 822 |
| FLJ12455 | NM_022078.1 | Forward Primer<br>Probe<br>Reverse Primer | CCACCAGCATGAAGTTTCG<br>ACCCCTCACAAAGGCCATGTCTGT<br>GGCTGTCTGAAGCACAACTG | SEQ ID NO: 823<br>SEQ ID NO: 824<br>SEQ ID NO: 825 |
| FLJ20712 | AK000719.1 | Forward Primer<br>Probe<br>Reverse Primer | GCCACACAAACATGCTCCT<br>ATGTCTTTCCCAGCAGCTCTGCCT<br>GCCACAGGAAACTTCCGA | SEQ ID NO: 826<br>SEQ ID NO: 827<br>SEQ ID NO: 828 |
| FLT1 | NM_002019.1 | Forward Primer<br>Probe<br>Reverse Primer | GGCTCCCGAATCTATCTTTG<br>CTACAGCACCAAGAGCGACGTGTG<br>TCCCACAGCAATACTCCGTA | SEQ ID NO: 829<br>SEQ ID NO: 830<br>SEQ ID NO: 831 |
| FLT4 | NM_002020.1 | Forward Primer<br>Probe<br>Reverse Primer | ACCAAGAAGCTGAGGACCTG<br>AGCCCGCTGACCATGGAAGATCT<br>CCTGGAAGCTGTAGCAGACA | SEQ ID NO: 832<br>SEQ ID NO: 833<br>SEQ ID NO: 834 |
| FOS | NM_005252.2 | Forward Primer<br>Probe<br>Reverse Primer | CGAGCCCTTTGATGACTTCCT<br>TCCCAGCATCATCCAGGCCCAG<br>GGAGCGGGCTGTCTCAGA | SEQ ID NO: 835<br>SEQ ID NO: 836<br>SEQ ID NO: 837 |
| FOXO3A | NM_001455.1 | Forward Primer<br>Probe<br>Reverse Primer | TGAAGTCCAGGACGATGATG<br>CTCTACAGCAGCTCAGCCAGCCTG<br>ACGGCTTGCTTACTGAAGGT | SEQ ID NO: 838<br>SEQ ID NO: 839<br>SEQ ID NO: 840 |
| FPGS | NM_004957.3 | Forward Primer<br>Probe<br>Reverse Primer | CAGCCCTGCCAGTTTGAC<br>ATGCCGTCTTCTGCCCTAACCTGA<br>GTTGCCTGTGGATGACACC | SEQ ID NO: 841<br>SEQ ID NO: 842<br>SEQ ID NO: 843 |
| FRP1 | NM_003012.2 | Forward Primer<br>Probe<br>Reverse Primer | TTGGTACCTGTGGGTTAGCA<br>TCCCCAGGGTAGAATTCAATCAGAGC<br>CACATCCAAATGCAAACTGG | SEQ ID NO: 844<br>SEQ ID NO: 845<br>SEQ ID NO: 846 |
| FST | NM_006350.2 | Forward Primer<br>Probe<br>Reverse Primer | GTAAGTCGGATGAGCCTGTCTGT<br>CCAGTGACAATGCCACTTATGCCAGC<br>CAGCTTCCTTCATGGCACACT | SEQ ID NO: 847<br>SEQ ID NO: 848<br>SEQ ID NO: 849 |
| Furin | NM_002569.1 | Forward Primer<br>Probe<br>Reverse Primer | AAGTCCTCGATACGCACTATAGCA<br>CCCGGATGGTCTCCACGTCAT<br>CTGGCATGTGGCACATGAG | SEQ ID NO: 850<br>SEQ ID NO: 851<br>SEQ ID NO: 852 |
| FUS | NM_004960.1 | Forward Primer<br>Probe<br>Reverse Primer | GGATAATTCAGACAACAACACCATCT<br>TCAATTGTAACATTCTCACCCAGGCCTTG<br>TGAAGTAATCAGCCACAGACTCAAT | SEQ ID NO: 853<br>SEQ ID NO: 854<br>SEQ ID NO: 855 |
| FUT1 | NM_000148.1 | Forward Primer<br>Probe<br>Reverse Primer | CCGTGCTCATTGCTAACCA<br>TCTGTCCCTGAACTCCCAGAACCA<br>CTGCCCAAAGCCAGATGTA | SEQ ID NO: 856<br>SEQ ID NO: 857<br>SEQ ID NO: 858 |

TABLE A-continued

| Gene | Accession | Reagent | Sequence | Sequence ID Number |
|---|---|---|---|---|
| FUT3 | NM_000149.1 | Forward Primer<br>Probe<br>Reverse Primer | CAGTTCGGTCCAACAGAGAA<br>AGCAGGCAACCACCATGTCATTTG<br>TGCGAATTATATCCCGATGA | SEQ ID NO: 859<br>SEQ ID NO: 860<br>SEQ ID NO: 861 |
| FUT6 | NM_000150.1 | Forward Primer<br>Probe<br>Reverse Primer | CGTGTGTCTCAAGACGATCC<br>TGTGTACCCTAATGGGTCCCGCTT<br>GGTCCCTGTGCTGTCTGG | SEQ ID NO: 862<br>SEQ ID NO: 863<br>SEQ ID NO: 864 |
| FXYD5 | NM_014164.4 | Forward Primer<br>Probe<br>Reverse Primer | AGAGCACCAAAGCAGCTCAT<br>CACTGATGACACCACGACGCTCTC<br>GTGCTTGGGGATGGTCTCT | SEQ ID NO: 865<br>SEQ ID NO: 866<br>SEQ ID NO: 867 |
| FYN | NM_002037.3 | Forward Primer<br>Probe<br>Reverse Primer | GAAGCGCAGATCATGAAGAA<br>CTGAAGCACGACAAGCTGGTCCAG<br>CTCCTCAGACACCACTGCAT | SEQ ID NO: 868<br>SEQ ID NO: 869<br>SEQ ID NO: 870 |
| FZD1 | NM_003505.1 | Forward Primer<br>Probe<br>Reverse Primer | GGTGCACCAGTTCTACCCTC<br>ACTTGAGCTCAGCGGAACACTGCA<br>GCGTACATGGAGCACAGGA | SEQ ID NO: 871<br>SEQ ID NO: 872<br>SEQ ID NO: 873 |
| FZD2 | NM_001466.2 | Forward Primer<br>Probe<br>Reverse Primer | TGGATCCTCACCTGGTCG<br>TGCGCTTCCACCTTCTTCACTGTC<br>GCGCTGCATGTCTACCAA | SEQ ID NO: 874<br>SEQ ID NO: 875<br>SEQ ID NO: 876 |
| FZD6 | NM_003506.2 | Forward Primer<br>Probe<br>Reverse Primer | AATGAGAGAGGTGAAAGCGG<br>CGGAGCTAGCACCCCCAGGTTAAG<br>AGGTTCACCACAGTCCTGTTC | SEQ ID NO: 877<br>SEQ ID NO: 878<br>SEQ ID NO: 879 |
| G-Catenin | NM_002230.1 | Forward Primer<br>Probe<br>Reverse Primer | TCAGCAGCAAGGGCATCAT<br>CGCCCGCAGGCCTCATCCT<br>GGTGGTTTTCTTGAGCGTGTACT | SEQ ID NO: 880<br>SEQ ID NO: 881<br>SEQ ID NO: 882 |
| G1P2 | NM_005101.1 | Forward Primer<br>Probe<br>Reverse Primer | CAACGAATTCCAGGTGTCC<br>CTGAGCAGCTCCATGTCGGTGTC<br>GATCTGCGCCTTCAGCTC | SEQ ID NO: 883<br>SEQ ID NO: 884<br>SEQ ID NO: 885 |
| GADD45 | NM_001924.2 | Forward Primer<br>Probe<br>Reverse Primer | GTGCTGGTGACGAATCCA<br>TTCATCTCAATGGAAGGATCCTGCC<br>CCCGGCAAAAACAAATAAGT | SEQ ID NO: 886<br>SEQ ID NO: 887<br>SEQ ID NO: 888 |
| GADD45B | NM_015675.1 | Forward Primer<br>Probe<br>Reverse Primer | ACCCTCGACAAGACCACACT<br>AACTTCAGCCCCAGCTCCCAAGTC<br>TGGGAGTTCATGGGTACAGA | SEQ ID NO: 889<br>SEQ ID NO: 890<br>SEQ ID NO: 891 |
| GADD45G | NM_006705.2 | Forward Primer<br>Probe<br>Reverse Primer | CGCGCTGCAGATCCATTT<br>CGCTGATCCAGGCTTTCTGCTGC<br>CGCACTATGTCGATGTCGTTCT | SEQ ID NO: 892<br>SEQ ID NO: 893<br>SEQ ID NO: 894 |
| GAGE4 | NM_001474.1 | Forward Primer<br>Probe<br>Reverse Primer | GGAACAGGGTCACCCACAGA<br>TCAGGACCATCTTCACACTCACACCCA<br>GATTTGGCGGGTCCATCTC | SEQ ID NO: 895<br>SEQ ID NO: 896<br>SEQ ID NO: 897 |
| GBP1 | NM_002053.1 | Forward Primer<br>Probe<br>Reverse Primer | TTGGGAAATATTTGGGCATT<br>TTGGGACATTGTAGACTTGGCCAGAC<br>AGAAGCTAGGGTGGTTGTCC | SEQ ID NO: 898<br>SEQ ID NO: 899<br>SEQ ID NO: 900 |
| GBP2 | NM_004120.2 | Forward Primer<br>Probe<br>Reverse Primer | GCATGGGAACCATCAACCA<br>CCATGGACCAACTTCACTATGTGACAGAGC<br>TGAGGAGTTTGCCTTGATTCG | SEQ ID NO: 901<br>SEQ ID NO: 902<br>SEQ ID NO: 903 |
| GCLC | NM_001498.1 | Forward Primer<br>Probe<br>Reverse Primer | CTGTTGCAGGAAGGCATTGA<br>CATCTCCTGGCCCAGCATGTT<br>GTCAGTGGGTCTCTAATAAAGAGATGAG | SEQ ID NO: 904<br>SEQ ID NO: 905<br>SEQ ID NO: 906 |
| GCLM | NM_002061.1 | Forward Primer<br>Probe<br>Reverse Primer | TGTAGAATCAAACTCTTCATCATCAACTAG<br>TGCAGTTGACATGGCCTGTTCAGTCC<br>CACAGAATCCAGCTGTGCAACT | SEQ ID NO: 907<br>SEQ ID NO: 908<br>SEQ ID NO: 909 |
| GCNT1 | NM_001490.3 | Forward Primer<br>Probe<br>Reverse Primer | TGGTGCTTGGAGCATAGAAG<br>TGCCCTTCACAAAGGAAATCCCTG<br>GCAACGTCCTCAGCATTTC | SEQ ID NO: 910<br>SEQ ID NO: 911<br>SEQ ID NO: 912 |
| GDF15 | NM_004864.1 | Forward Primer<br>Probe<br>Reverse Primer | CGCTCCAGACCTATGATGACT<br>TGTTAGCCAAAGACTGCCACTGCA<br>ACAGTGGAAGGACCAGGACT | SEQ ID NO: 913<br>SEQ ID NO: 914<br>SEQ ID NO: 915 |

TABLE A-continued

| Gene | Accession | Reagent | Sequence | Sequence ID Number |
|---|---|---|---|---|
| GIT1 | NM_014030.2 | Forward Primer<br>Probe<br>Reverse Primer | GTGTATGACGAGGTGGATCG<br>AGCCAGCCACACTGCATCATTTTC<br>ACCAGAGTGCTGTGGTTTTG | SEQ ID NO: 916<br>SEQ ID NO: 917<br>SEQ ID NO: 918 |
| GJA1 | NM_000165.2 | Forward Primer<br>Probe<br>Reverse Primer | GTTCACTGGGGGTGTATGG<br>ATCCCCTCCCTCTCCACCCATCTA<br>AAATACCAACATGCACCTCTCTT | SEQ ID NO: 919<br>SEQ ID NO: 920<br>SEQ ID NO: 921 |
| GJB2 | NM_004004.3 | Forward Primer<br>Probe<br>Reverse Primer | TGTCATGTACGACGGCTTCT<br>AGGCGTTGCACTTCACCAGCC<br>AGTCCACAGTGTTGGGACAA | SEQ ID NO: 922<br>SEQ ID NO: 923<br>SEQ ID NO: 924 |
| GPX1 | NM_000581.2 | Forward Primer<br>Probe<br>Reverse Primer | GCTTATGACCGACCCCAA<br>CTCATCACCTGGTCTCCGGTGTGT<br>AAAGTTCCAGGCAACATCGT | SEQ ID NO: 925<br>SEQ ID NO: 926<br>SEQ ID NO: 927 |
| GPX2 | NM_002083.1 | Forward Primer<br>Probe<br>Reverse Primer | CACACAGATCTCCTACTCCATCCA<br>CATGCTGCATCCTAAGGCTCCTCAGG<br>GGTCCAGCAGTGTCTCCTGAA | SEQ ID NO: 928<br>SEQ ID NO: 929<br>SEQ ID NO: 930 |
| Grb10 | NM_005311.2 | Forward Primer<br>Probe<br>Reverse Primer | CTTCGCCTTTGCTGATTGC<br>CTCCAAACGCCTGCCTGACGACTG<br>CCATAACGCACATGCTCCAA | SEQ ID NO: 931<br>SEQ ID NO: 932<br>SEQ ID NO: 933 |
| GRB14 | NM_004490.1 | Forward Primer<br>Probe<br>Reverse Primer | TCCCACTGAAGCCCTTTCAG<br>CCTCCAAGCGAGTCCTTCTTCAACCG<br>AGTGCCCAGGCGTAAACATC | SEQ ID NO: 934<br>SEQ ID NO: 935<br>SEQ ID NO: 936 |
| GRB2 | NM_002086.2 | Forward Primer<br>Probe<br>Reverse Primer | GTCCATCAGTGCATGACGTT<br>AGGCCACGTATAGTCCTAGCTGACGC<br>AGCCCACTTGGTTTCTTGTT | SEQ ID NO: 937<br>SEQ ID NO: 938<br>SEQ ID NO: 939 |
| GRB7 | NM_005310.1 | Forward Primer<br>Probe<br>Reverse Primer | CCATCTGCATCCATCTTGTT<br>CTCCCCACCCTTGAGAAGTGCCT<br>GGCCACCAGGGTATTATCTG | SEQ ID NO: 940<br>SEQ ID NO: 941<br>SEQ ID NO: 942 |
| GRIK1 | NM_000830.2 | Forward Primer<br>Probe<br>Reverse Primer | GTTGGGTGCATCTCTCGG<br>AATTCATGCCGAGATACAGCCGCT<br>CGTGCTCCATCTTCCTAGCTT | SEQ ID NO: 943<br>SEQ ID NO: 944<br>SEQ ID NO: 945 |
| GRO1 | NM_001511.1 | Forward Primer<br>Probe<br>Reverse Primer | CGAAAAGATGCTGAACAGTGACA<br>CTTCCTCCTCCCTTCTGGTCAGTTGGAT<br>TCAGGAACAGCCACCAGTGA | SEQ ID NO: 946<br>SEQ ID NO: 947<br>SEQ ID NO: 948 |
| GRP | NM_002091.1 | Forward Primer<br>Probe<br>Reverse Primer | CTGGGTCTCATAGAAGCAAAGGA<br>AGAAACCACCAGCCACCTCAACCCA<br>CCACGAAGGCTGCTGATTG | SEQ ID NO: 949<br>SEQ ID NO: 950<br>SEQ ID NO: 951 |
| GRPR | NM_005314.1 | Forward Primer<br>Probe<br>Reverse Primer | ATGCTGCTGGCCATTCCA<br>CCGTGTTTTCTGACCTCCATCCCTTCC<br>AGGTCTGGTTGGTGCTTTCCT | SEQ ID NO: 952<br>SEQ ID NO: 953<br>SEQ ID NO: 954 |
| GSK3B | NM_002093.2 | Forward Primer<br>Probe<br>Reverse Primer | GACAAGGACGGCAGCAAG<br>CCAGGAGTTGCCACCACTGTTGTC<br>TTGTGGCCTGTCTGGACC | SEQ ID NO: 955<br>SEQ ID NO: 956<br>SEQ ID NO: 957 |
| GSTA3 | NM_000847.3 | Forward Primer<br>Probe<br>Reverse Primer | TCTCCAACTTCCCTCTGCTG<br>AGGCCCTGAAAACCAGAATCAGCA<br>ACTTCTTCACCGTGGGCA | SEQ ID NO: 958<br>SEQ ID NO: 959<br>SEQ ID NO: 960 |
| GSTM1 | NM_000561.1 | Forward Primer<br>Probe<br>Reverse Primer | AAGCTATGAGGAAAAGAAGTACACGAT<br>TCAGCCACTGGCTTCTGTCATAATCAGGAG<br>GGCCCAGCTTGAATTTTTCA | SEQ ID NO: 961<br>SEQ ID NO: 962<br>SEQ ID NO: 963 |
| GSTM3 | NM_000849.3 | Forward Primer<br>Probe<br>Reverse Primer | CAATGCCATCTTGCGCTACAT<br>CTCGCAAGCACAACATGTGTGGTGAGA<br>GTCCACTCGAATCTTTTCTTCTTCA | SEQ ID NO: 964<br>SEQ ID NO: 965<br>SEQ ID NO: 966 |
| GSTp | NM_000852.2 | Forward Primer<br>Probe<br>Reverse Primer | GAGACCCTGCTGTCCCAGAA<br>TCCCACAATGAAGGTCTTGCCTCCCT<br>GGTTGTAGTCAGCGAAGGAGATC | SEQ ID NO: 967<br>SEQ ID NO: 968<br>SEQ ID NO: 969 |
| GSTT1 | NM_000853.1 | Forward Primer<br>Probe<br>Reverse Primer | CACCATCCCCACCCTGTCT<br>CACAGCCGCCTGAAAGCCACAAT<br>GGCCTCAGTGTGCATCATTCT | SEQ ID NO: 970<br>SEQ ID NO: 971<br>SEQ ID NO: 972 |

TABLE A-continued

| Gene | Accession | Reagent | Sequence | Sequence ID Number |
|---|---|---|---|---|
| H2AFZ | NM_002106.2 | Forward Primer<br>Probe<br>Reverse Primer | CCGGAAAGGCCAAGACAA<br>CCCGCTCGCAGAGAGCCGG<br>AATACGGCCCACTGGGAACT | SEQ ID NO: 973<br>SEQ ID NO: 974<br>SEQ ID NO: 975 |
| HB-EGF | NM_001945.1 | Forward Primer<br>Probe<br>Reverse Primer | GACTCCTTCGTCCCCAGTTG<br>TTGGGCCTCCCATAATTGCTTTGCC<br>TGGCACTTGAAGGCTCTGGTA | SEQ ID NO: 976<br>SEQ ID NO: 977<br>SEQ ID NO: 978 |
| hCRA a | U78556.1 | Forward Primer<br>Probe<br>Reverse Primer | TGACACCCTTACCTTCCTGAGAA<br>TCTGCTTTCCGCGCTCCAGG<br>AAAAACACGAGTCAAAAATAGAAGTCACT | SEQ ID NO: 979<br>SEQ ID NO: 980<br>SEQ ID NO: 981 |
| HDAC1 | NM_004964.2 | Forward Primer<br>Probe<br>Reverse Primer | CAAGTACCACAGCGATGACTACATTAA<br>TTCTTGCGCTCCATCCGTCCAGA<br>GCTTGCTGTACTCCGACATGTT | SEQ ID NO: 982<br>SEQ ID NO: 983<br>SEQ ID NO: 984 |
| HDAC2 | NM_001527.1 | Forward Primer<br>Probe<br>Reverse Primer | GGTGGCTACACAATCCGTAA<br>TGCAGTCTCATATGTCCAACATCGAGC<br>TGGGAATCTCACAATCAAGG | SEQ ID NO: 985<br>SEQ ID NO: 986<br>SEQ ID NO: 987 |
| HDGF | NM_004494.1 | Forward Primer<br>Probe<br>Reverse Primer | TCCTAGGCATTCTGGACCTC<br>CATTCCTACCCCTGATCCCAACCC<br>GCTGTTGATGCTCCATCCTT | SEQ ID NO: 988<br>SEQ ID NO: 989<br>SEQ ID NO: 990 |
| hENT1 | NM_004955.1 | Forward Primer<br>Probe<br>Reverse Primer | AGCCGTGACTGTTGAGGTC<br>AAGTCCAGCATCGCAGGCAGC<br>AAGTAACGTTCCCAGGTGCT | SEQ ID NO: 991<br>SEQ ID NO: 992<br>SEQ ID NO: 993 |
| Hepsin | NM_002151.1 | Forward Primer<br>Probe<br>Reverse Primer | AGGCTGCTGGAGGTCATCTC<br>CCAGAGGCCGTTTCTTGGCCG<br>CTTCCTGCGGCCACAGTCT | SEQ ID NO: 994<br>SEQ ID NO: 995<br>SEQ ID NO: 996 |
| HER2 | NM_004448.1 | Forward Primer<br>Probe<br>Reverse Primer | CGGTGTGAGAAGTGCAGCAA<br>CCAGACCATAGCACACTCGGGCAC<br>CCTCTCGCAAGTGCTCCAT | SEQ ID NO: 997<br>SEQ ID NO: 998<br>SEQ ID NO: 999 |
| Herstatin | AF177761.2 | Forward Primer<br>Probe<br>Reverse Primer | CACCCTGTCCTATCCTTCCT<br>CCCTCTTGGGACCTAGTCTCTGCCT<br>GGCCAGGGGTAGAGAGTAGA | SEQ ID NO: 1000<br>SEQ ID NO: 1001<br>SEQ ID NO: 1002 |
| HES6 | NM_018645.3 | Forward Primer<br>Probe<br>Reverse Primer | TTAGGGACCCTGCAGCTCT<br>TAGCTCCCTCCCTCCACCCACTC<br>CTACAAAATTCTTCCTCCTGCC | SEQ ID NO: 1003<br>SEQ ID NO: 1004<br>SEQ ID NO: 1005 |
| HGF | M29145.1 | Forward Primer<br>Probe<br>Reverse Primer | CCGAAATCCAGATGATGATG<br>CTCATGGACCCTGGTGCTACACG<br>CCCAAGGAATGAGTGGATTT | SEQ ID NO: 1006<br>SEQ ID NO: 1007<br>SEQ ID NO: 1008 |
| HIF1A | NM_001530.1 | Forward Primer<br>Probe<br>Reverse Primer | TGAACATAAAGTCTGCAACATGGA<br>TTGCACTGCACAGGCCACATTCAC<br>TGAGGTTGGTTACTGTTGGTATCATATA | SEQ ID NO: 1009<br>SEQ ID NO: 1010<br>SEQ ID NO: 1011 |
| HK1 | NM_000188.1 | Forward Primer<br>Probe<br>Reverse Primer | TACGCACAGAGGCAAGCA<br>TAAGAGTCCGGGATCCCCAGCCTA<br>GAGAGAAGTGCTGGAGAGGC | SEQ ID NO: 1012<br>SEQ ID NO: 1013<br>SEQ ID NO: 1014 |
| HLA-DPB1 | NM_002121.4 | Forward Primer<br>Probe<br>Reverse Primer | TCCATGATGGTTCTGCAGGTT<br>CCCCGGACAGTGGCTCTGACG<br>TGAGCAGCACCATCAGTAACG | SEQ ID NO: 1015<br>SEQ ID NO: 1016<br>SEQ ID NO: 1017 |
| HLA-DRA | NM_019111.3 | Forward Primer<br>Probe<br>Reverse Primer | GACGATTTGCCAGCTTTGAG<br>TCAAGGTGCATTGGCCAACATAGC<br>TCCAGGTTGGCTTTGTCC | SEQ ID NO: 1018<br>SEQ ID NO: 1019<br>SEQ ID NO: 1020 |
| HLA-DRB1 | NM_002124.1 | Forward Primer<br>Probe<br>Reverse Primer | GCTTTCTCAGGACCTGGTTG<br>CATTTTCTGCAGTTGCCGAACCAG<br>AGGAAGCCACAAGGGAGG | SEQ ID NO: 1021<br>SEQ ID NO: 1022<br>SEQ ID NO: 1023 |
| HLA-G | NM_002127.2 | Forward Primer<br>Probe<br>Reverse Primer | CCTGCGCGGCTACTACAAC<br>CGAGGCCAGTTCTCACACCCTCCAG<br>CAGGTCGCAGCCAATCATC | SEQ ID NO: 1024<br>SEQ ID NO: 1025<br>SEQ ID NO: 1026 |
| HMGB1 | NM_002128.3 | Forward Primer<br>Probe<br>Reverse Primer | TGGCCTGTCCATTGGTGAT<br>TTCCACATCTCTCCCAGTTTCTTCGCAA<br>GCTTGTCATCTGCAGCAGTGTT | SEQ ID NO: 1027<br>SEQ ID NO: 1028<br>SEQ ID NO: 1029 |

TABLE A-continued

| Gene | Accession | Reagent | Sequence | Sequence ID Number |
|---|---|---|---|---|
| hMLH | NM_000249.2 | Forward Primer | CTACTTCCAGCAACCCCAGA | SEQ ID NO: 1030 |
|  |  | Probe | TCCACATCAGAATCTTCCCG | SEQ ID NO: 1031 |
|  |  | Reverse Primer | CTTTCGGGAATCATCTTCCA | SEQ ID NO: 1032 |
| HNRPAB | NM_004499.2 | Forward Primer | CAAGGGAGCGACCAACTGA | SEQ ID NO: 1033 |
|  |  | Probe | CTCCATATCCAAACAAAGCATGTGTGCG | SEQ ID NO: 1034 |
|  |  | Reverse Primer | GTTTGCCAAGTTAAATTTGGTACATAAT | SEQ ID NO: 1035 |
| HNRPD | NM_031370.2 | Forward Primer | GCCAGTAAGAACGAGGAGGA | SEQ ID NO: 1036 |
|  |  | Probe | AAGGCCATTCAAACTCCTCCCCAC | SEQ ID NO: 1037 |
|  |  | Reverse Primer | CGTCGCTGCTTCAGAGTGT | SEQ ID NO: 1038 |
| HoxA1 | NM_005522.3 | Forward Primer | AGTGACAGATGGACAATGCAAGA | SEQ ID NO: 1039 |
|  |  | Probe | TGAACTCCTTCCTGGAATACCCCA | SEQ ID NO: 1040 |
|  |  | Reverse Primer | CCGAGTCGCCACTGCTAAGT | SEQ ID NO: 1041 |
| HoxA5 | NM_019102.2 | Forward Primer | TCCCTTGTGTTCCTTCTGTGAA | SEQ ID NO: 1042 |
|  |  | Probe | AGCCCTGTTCTCGTTGCCCTAATTCATC | SEQ ID NO: 1043 |
|  |  | Reverse Primer | GGCAATAAACAGGCTCATGATTAA | SEQ ID NO: 1044 |
| HOXB13 | NM_006361.2 | Forward Primer | CGTGCCTTATGGTTACTTTGG | SEQ ID NO: 1045 |
|  |  | Probe | ACACTCGGCAGGAGTAGTACCCGC | SEQ ID NO: 1046 |
|  |  | Reverse Primer | CACAGGGTTTCAGCGAGC | SEQ ID NO: 1047 |
| HOXB7 | NM_004502.2 | Forward Primer | CAGCCTCAAGTTCGGTTTTC | SEQ ID NO: 1048 |
|  |  | Probe | ACCGGAGCCTTCCCAGAACAAACT | SEQ ID NO: 1049 |
|  |  | Reverse Primer | GTTGGAAGCAAACGCACA | SEQ ID NO: 1050 |
| HRAS | NM_005343.2 | Forward Primer | GGACGAATACGACCCCACT | SEQ ID NO: 1051 |
|  |  | Probe | ACCACCTGCTTCCGGTAGGAATCC | SEQ ID NO: 1052 |
|  |  | Reverse Primer | GCACGTCTCCCCATCAAT | SEQ ID NO: 1053 |
| HSBP1 | NM_001537.1 | Forward Primer | GGAGATGGCCGAGACTGAC | SEQ ID NO: 1054 |
|  |  | Probe | CAAGACCGTGCAGGACCTCACCT | SEQ ID NO: 1055 |
|  |  | Reverse Primer | CTGCAGGAGTGTCTGCACC | SEQ ID NO: 1056 |
| HSD17B1 | NM_000413.1 | Forward Primer | CTGGACCGCACGGACATC | SEQ ID NO: 1057 |
|  |  | Probe | ACCGCTTCTACCAATACCTCGCCCA | SEQ ID NO: 1058 |
|  |  | Reverse Primer | CGCCTCGCGAAAGACTTG | SEQ ID NO: 1059 |
| HSD17B2 | NM_002153.1 | Forward Primer | GCTTTCCAAGTGGGGAATTA | SEQ ID NO: 1060 |
|  |  | Probe | AGTTGCTTCCATCCAACCTGGAGG | SEQ ID NO: 1061 |
|  |  | Reverse Primer | TGCCTGCGATATTTGTTAGG | SEQ ID NO: 1062 |
| HSPA1A | NM_005345.4 | Forward Primer | CTGCTGCGACAGTCCACTA | SEQ ID NO: 1063 |
|  |  | Probe | AGAGTGACTCCCGTTGTCCCAAGG | SEQ ID NO: 1064 |
|  |  | Reverse Primer | CAGGTTCGCTCTGGGAAG | SEQ ID NO: 1065 |
| HSPA1B | NM_005346.3 | Forward Primer | GGTCCGCTTCGTCTTTCGA | SEQ ID NO: 1066 |
|  |  | Probe | TGACTCCCGCGGTCCCAAGG | SEQ ID NO: 1067 |
|  |  | Reverse Primer | GCACAGGTTCGCTCTGGAA | SEQ ID NO: 1068 |
| HSPA4 | NM_002154.3 | Forward Primer | TTCAGTGTGTCCAGTGCATC | SEQ ID NO: 1069 |
|  |  | Probe | CATTTTCCTCAGACTTGTGAACCTCCACT | SEQ ID NO: 1070 |
|  |  | Reverse Primer | ATCTGTTTCCATTGGCTCCT | SEQ ID NO: 1071 |
| HSPA5 | NM_005347.2 | Forward Primer | GGCTAGTAGAACTGGATCCCAACA | SEQ ID NO: 1072 |
|  |  | Probe | TAATTAGACCTAGGCCTCAGCTGCACTGCC | SEQ ID NO: 1073 |
|  |  | Reverse Primer | GGTCTGCCCAAATGCTTTTC | SEQ ID NO: 1074 |
| HSPA8 | NM_006597.3 | Forward Primer | CCTCCCTCTGGTGGTGCTT | SEQ ID NO: 1075 |
|  |  | Probe | CTCAGGGCCCACCATTGAAGAGGTTG | SEQ ID NO: 1076 |
|  |  | Reverse Primer | GCTACATCTACACTTGGTTGGCTTAA | SEQ ID NO: 1077 |
| HSPB1 | NM_001540.2 | Forward Primer | CCGACTGGAGGAGCATAAA | SEQ ID NO: 1078 |
|  |  | Probe | CGCACTTTTCTGAGCAGACGTCCA | SEQ ID NO: 1079 |
|  |  | Reverse Primer | ATGCTGGCTGACTCTGCTC | SEQ ID NO: 1080 |
| HSPCA | NM_005348.2 | Forward Primer | CAAAAGGCAGAGGCTGATAA | SEQ ID NO: 1081 |
|  |  | Probe | TGACCAGATCCTTCACAGACTTGTCGT | SEQ ID NO: 1082 |
|  |  | Reverse Primer | AGCGCAGTTTCATAAAGCAA | SEQ ID NO: 1083 |
| HSPE1 | NM_002157.1 | Forward Primer | GCAAGCAACAGTAGTCGCTG | SEQ ID NO: 1084 |
|  |  | Probe | TCTCCACCCTTTCCTTTAGAACCCG | SEQ ID NO: 1085 |
|  |  | Reverse Primer | CCAACTTTCACGCTAACTGGT | SEQ ID NO: 1086 |

TABLE A-continued

| Gene | Accession | Reagent | Sequence | Sequence ID Number |
|---|---|---|---|---|
| HSPG2 | NM_005529.2 | Forward Primer<br>Probe<br>Reverse Primer | GAGTACGTGTGCCGAGTGTT<br>CAGCTCCGTGCCTCTAGAGGCCT<br>CTCAATGGTGACCAGGACA | SEQ ID NO: 1087<br>SEQ ID NO: 1088<br>SEQ ID NO: 1089 |
| ICAM1 | NM_000201.1 | Forward Primer<br>Probe<br>Reverse Primer | GCAGACAGTGACCATCTACAGCTT<br>CCGGCGCCCAACGTGATTCT<br>CTTCTGAGACCTCTGGCTTCGT | SEQ ID NO: 1090<br>SEQ ID NO: 1091<br>SEQ ID NO: 1092 |
| ICAM2 | NM_000873.2 | Forward Primer<br>Probe<br>Reverse Primer | GGTCATCCTGACACTGCAAC<br>TTGCCCACAGCCACCAAAGTG<br>TGCACTCAATGGTGAAGGAC | SEQ ID NO: 1093<br>SEQ ID NO: 1094<br>SEQ ID NO: 1095 |
| ID1 | NM_002165.1 | Forward Primer<br>Probe<br>Reverse Primer | AGAACCGCAAGGTGAGCAA<br>TGGAGATTCTCCAGCACGTCATCGAC<br>TCCAACTGAAGGTCCCTGATG | SEQ ID NO: 1096<br>SEQ ID NO: 1097<br>SEQ ID NO: 1098 |
| ID2 | NM_002166.1 | Forward Primer<br>Probe<br>Reverse Primer | AACGACTGCTACTCCAAGCTCAA<br>TGCCCAGCATCCCCCAGAACAA<br>GGATTTCCATCTTGCTCACCTT | SEQ ID NO: 1099<br>SEQ ID NO: 1100<br>SEQ ID NO: 1101 |
| ID3 | NM_002167.2 | Forward Primer<br>Probe<br>Reverse Primer | CTTCACCAAATCCCTTCCTG<br>TCACAGTCCTTCGCTCCTGAGCAC<br>CTCTGGCTCTTCAGGCTACA | SEQ ID NO: 1102<br>SEQ ID NO: 1103<br>SEQ ID NO: 1104 |
| ID4 | NM_001546.2 | Forward Primer<br>Probe<br>Reverse Primer | TGGCCTGGCTCTTAATTTG<br>CTTTTGTTTTGCCCAGTATAGACTCGGAAG<br>TGCAATCATGCAAGACCAC | SEQ ID NO: 1105<br>SEQ ID NO: 1106<br>SEQ ID NO: 1107 |
| IFIT1 | NM_001548.1 | Forward Primer<br>Probe<br>Reverse Primer | TGACAACCAAGCAAATGTGA<br>AAGTTGCCCCAGGTCACCAGACTC<br>CAGTCTGCCCATGTGGTAAT | SEQ ID NO: 1108<br>SEQ ID NO: 1109<br>SEQ ID NO: 1110 |
| IGF1 | NM_000618.1 | Forward Primer<br>Probe<br>Reverse Primer | TCCGGAGCTGTGATCTAAGGA<br>TGTATTGCGCACCCCTCAAGCCTG<br>CGGACAGAGCGAGCTGACTT | SEQ ID NO: 1111<br>SEQ ID NO: 1112<br>SEQ ID NO: 1113 |
| IGF1R | NM_000875.2 | Forward Primer<br>Probe<br>Reverse Primer | GCATGGTAGCCGAAGATTTCA<br>CGCGTCATACCAAAATCTCCGATTTTGA<br>TTTCCGGTAATAGTCTGTCTCATAGATATC | SEQ ID NO: 1114<br>SEQ ID NO: 1115<br>SEQ ID NO: 1116 |
| IGF2 | NM_000612.2 | Forward Primer<br>Probe<br>Reverse Primer | CCGTGCTTCCGGACAACTT<br>TACCCCGTGGGCAAGTTCTTCCAA<br>TGGACTGCTTCCAGGTGTCA | SEQ ID NO: 1117<br>SEQ ID NO: 1118<br>SEQ ID NO: 1119 |
| IGFBP2 | NM_000597.1 | Forward Primer<br>Probe<br>Reverse Primer | GTGGACAGCACCATGAACA<br>CTTCCGGCCAGCACTGCCTC<br>CCTTCATACCCGACTTGAGG | SEQ ID NO: 1120<br>SEQ ID NO: 1121<br>SEQ ID NO: 1122 |
| IGFBP3 | NM_000598.1 | Forward Primer<br>Probe<br>Reverse Primer | ACGCACCGGGTGTCTGA<br>CCCAAGTTCCACCCCCTCCATTCA<br>TGCCCTTTCTTGATGATGATTATC | SEQ ID NO: 1123<br>SEQ ID NO: 1124<br>SEQ ID NO: 1125 |
| IGFBP5 | NM_000599.1 | Forward Primer<br>Probe<br>Reverse Primer | TGGACAAGTACGGGATGAAGCT<br>CCCGTCAACGTACTCCATGCCTGG<br>CGAAGGTGTGGCACTGAAAGT | SEQ ID NO: 1126<br>SEQ ID NO: 1127<br>SEQ ID NO: 1128 |
| IGFBP6 | NM_002178.1 | Forward Primer<br>Probe<br>Reverse Primer | TGAACCGCAGAGACCAACAG<br>ATCCAGGCACCTCTACCACGCCCTC<br>GTCTTGGACACCCGCAGAAT | SEQ ID NO: 1129<br>SEQ ID NO: 1130<br>SEQ ID NO: 1131 |
| IGFBP7 | NM_001553 | Forward Primer<br>Probe<br>Reverse Primer | GGGTCACTATGGAGTTCAAAGGA<br>CCCGGTCACCAGGCAGGAGTTCT<br>GGGTCTGAATGGCCAGGTT | SEQ ID NO: 1132<br>SEQ ID NO: 1133<br>SEQ ID NO: 1134 |
| IHH | NM_002181.1 | Forward Primer<br>Probe<br>Reverse Primer | AAGGACGAGGAGAACACAGG<br>ATGACCCAGCGCTGCAAGGAC<br>AGATAGCCAGCGAGTTCAGG | SEQ ID NO: 1135<br>SEQ ID NO: 1136<br>SEQ ID NO: 1137 |
| IL-8 | NM_000584.2 | Forward Primer<br>Probe<br>Reverse Primer | AAGGAACCATCTCACTGTGTGTAAAC<br>TGACTTCCAAGCTGGCCGTGGC<br>ATCAGGAAGGCTGCCAAGAG | SEQ ID NO: 1138<br>SEQ ID NO: 1139<br>SEQ ID NO: 1140 |
| IL10 | NM_000572.1 | Forward Primer<br>Probe<br>Reverse Primer | GGCGCTGTCATCGATTTCTT<br>CTGCTCCACGGCCTTGCTCTTG<br>TGGAGCTTATTAAAGGCATTCTTCA | SEQ ID NO: 1141<br>SEQ ID NO: 1142<br>SEQ ID NO: 1143 |

TABLE A-continued

| Gene | Accession | Reagent | Sequence | Sequence ID Number |
|---|---|---|---|---|
| IL1B | NM_000576.2 | Forward Primer<br>Probe<br>Reverse Primer | AGCTGAGGAAGATGCTGGTT<br>TGCCCACAGACCTTCCAGGAGAAT<br>GGAAAGAAGGTGCTCAGGTC | SEQ ID NO: 1144<br>SEQ ID NO: 1145<br>SEQ ID NO: 1146 |
| IL6 | NM_000600.1 | Forward Primer<br>Probe<br>Reverse Primer | CCTGAACCTTCCAAAGATGG<br>CCAGATTGGAAGCATCCATCTTTTTCA<br>ACCAGGCAAGTCTCCTCATT | SEQ ID NO: 1147<br>SEQ ID NO: 1148<br>SEQ ID NO: 1149 |
| IL6ST | NM_002184.2 | Forward Primer<br>Probe<br>Reverse Primer | GGCCTAATGTTCCAGATCCT<br>CATATTGCCCAGTGGTCACCTCACA<br>AAAATTGTGCCTTGGAGGAG | SEQ ID NO: 1150<br>SEQ ID NO: 1151<br>SEQ ID NO: 1152 |
| ILT-2 | NM_006669.1 | Forward Primer<br>Probe<br>Reverse Primer | AGCCATCACTCTCAGTGCAG<br>CAGGTCCTATCGTGGCCCCTGA<br>ACTGCAGAGTCAGGGTCTCC | SEQ ID NO: 1153<br>SEQ ID NO: 1154<br>SEQ ID NO: 1155 |
| IMP-1 | NM_006546.2 | Forward Primer<br>Probe<br>Reverse Primer | GAAAGTGTTTGCGGAGCAC<br>CTCCTACAGCGGCCAGTTCTTGGT<br>GAAGGCGTAGCCGGATTT | SEQ ID NO: 1156<br>SEQ ID NO: 1157<br>SEQ ID NO: 1158 |
| IMP2 | NM_006548.3 | Forward Primer<br>Probe<br>Reverse Primer | CAATCTGATCCCAGGGTTGAA<br>CTCAGCGCACTTGGCATCTTTTCAACA<br>GGCCCTGCTGGTGGAGATA | SEQ ID NO: 1159<br>SEQ ID NO: 1160<br>SEQ ID NO: 1161 |
| ING1L | NM_001564.1 | Forward Primer<br>Probe<br>Reverse Primer | TGTTTCCAAGATCCTGCTGA<br>CCATCTTTGCTTTATCTGAGGCTCGTTC<br>TCTTTCTGGTTGGCTGGAAT | SEQ ID NO: 1162<br>SEQ ID NO: 1163<br>SEQ ID NO: 1164 |
| ING5 | NM_032329.4 | Forward Primer<br>Probe<br>Reverse Primer | CCTACAGCAAGTGCAAGGAA<br>CCAGCTGCACTTTGTCGTCACTGT<br>CATCTCGTAGGTCTGCATGG | SEQ ID NO: 1165<br>SEQ ID NO: 1166<br>SEQ ID NO: 1167 |
| INHA | NM_002191.2 | Forward Primer<br>Probe<br>Reverse Primer | CCTCCCAGTTTCATCTTCCACTA<br>ATGTGCAGCCCACAACCACCATGA<br>AGGGACTGGAAGGGACAGGTT | SEQ ID NO: 1168<br>SEQ ID NO: 1169<br>SEQ ID NO: 1170 |
| INHBA | NM_002192.1 | Forward Primer<br>Probe<br>Reverse Primer | GTGCCCGAGCCATATAGCA<br>ACGTCCGGGTCCTCACTGTCCTTCC<br>CGGTAGTGGTTGATGACTGTTGA | SEQ ID NO: 1171<br>SEQ ID NO: 1172<br>SEQ ID NO: 1173 |
| INHBB | NM_002193.1 | Forward Primer<br>Probe<br>Reverse Primer | AGCCTCCAGGATACCAGCAA<br>AGCTAAGCTGCCATTTGTCACCG<br>TCTCCGACTGACAGGCATTTG | SEQ ID NO: 1174<br>SEQ ID NO: 1175<br>SEQ ID NO: 1176 |
| IRS1 | NM_005544.1 | Forward Primer<br>Probe<br>Reverse Primer | CCACAGCTCACCTTCTGTCA<br>TCCATCCCAGCTCCAGCCAG<br>CCTCAGTGCCAGTCTCTTCC | SEQ ID NO: 1177<br>SEQ ID NO: 1178<br>SEQ ID NO: 1179 |
| ITGA3 | NM_002204.1 | Forward Primer<br>Probe<br>Reverse Primer | CCATGATCCTCACTCTGCTG<br>CACTCCAGACCTCGCTTAGCATGG<br>GAAGCTTTGTAGCCGGTGAT | SEQ ID NO: 1180<br>SEQ ID NO: 1181<br>SEQ ID NO: 1182 |
| ITGA4 | NM_000885.2 | Forward Primer<br>Probe<br>Reverse Primer | CAACGCTTCAGTGATCAATCC<br>CGATCCTGCATCTGTAAATCGCCC<br>GTCTGGCCGGGATTCTTT | SEQ ID NO: 1183<br>SEQ ID NO: 1184<br>SEQ ID NO: 1185 |
| ITGA5 | NM_002205.1 | Forward Primer<br>Probe<br>Reverse Primer | AGGCCAGCCCTACATTATCA<br>TCTGAGCCTTGTCCTCTATCCGGC<br>GTCTTCTCCACAGTCCAGCA | SEQ ID NO: 1186<br>SEQ ID NO: 1187<br>SEQ ID NO: 1188 |
| ITGA6 | NM_000210.1 | Forward Primer<br>Probe<br>Reverse Primer | CAGTGACAAACAGCCCTTCC<br>TCGCCATCTTTTGTGGGATTCCTT<br>GTTTAGCCTCATGGGCGTC | SEQ ID NO: 1189<br>SEQ ID NO: 1190<br>SEQ ID NO: 1191 |
| ITGA7 | NM_002206.1 | Forward Primer<br>Probe<br>Reverse Primer | GATATGATTGGTCGCTGCTTTG<br>CAGCCAGGACCTGGCCATCCG<br>AGAACTTCCATTCCCCACCAT | SEQ ID NO: 1192<br>SEQ ID NO: 1193<br>SEQ ID NO: 1194 |
| ITGAV | NM_002210.2 | Forward Primer<br>Probe<br>Reverse Primer | ACTCGGACTGCACAAGCTATT<br>CCGACAGCCACAGAATAACCCAAA<br>TGCCATCACCATTGAAATCT | SEQ ID NO: 1195<br>SEQ ID NO: 1196<br>SEQ ID NO: 1197 |
| ITGB1 | NM_002211.2 | Forward Primer<br>Probe<br>Reverse Primer | TCAGAATTGGATTTGGCTCA<br>TGCTAATGTAAGGCATCACAGTCTTTTCCA<br>CCTGAGCTTAGCTGGTGTTG | SEQ ID NO: 1198<br>SEQ ID NO: 1199<br>SEQ ID NO: 1200 |

TABLE A-continued

| Gene | Accession | Reagent | Sequence | Sequence ID Number |
|---|---|---|---|---|
| ITGB3 | NM_000212.1 | Forward Primer | ACCGGGAGCCCTACATGAC | SEQ ID NO: 1201 |
| | | Probe | AAATACCTGCAACCGTTACTGCCGTGAC | SEQ ID NO: 1202 |
| | | Reverse Primer | CCTTAAGCTCTTTCACTGACTCAATCT | SEQ ID NO: 1203 |
| ITGB4 | NM_000213.2 | Forward Primer | CAAGGTGCCCTCAGTGGA | SEQ ID NO: 1204 |
| | | Probe | CACCAACCTGTACCCGTATTGCGA | SEQ ID NO: 1205 |
| | | Reverse Primer | GCGCACACCTTCATCTCAT | SEQ ID NO: 1206 |
| ITGB5 | NM_002213.3 | Forward Primer | TCGTGAAAGATGACCAGGAG | SEQ ID NO: 1207 |
| | | Probe | TGCTATGTTTCTACAAAACCGCCAAGG | SEQ ID NO: 1208 |
| | | Reverse Primer | GGTGAACATCATGACGCAGT | SEQ ID NO: 1209 |
| K-ras | NM_033360.2 | Forward Primer | GTCAAAATGGGGAGGGACTA | SEQ ID NO: 1210 |
| | | Probe | TGTATCTTGTTGAGCTATCCAAACTGCCC | SEQ ID NO: 1211 |
| | | Reverse Primer | CAGGACCACCACAGAGTGAG | SEQ ID NO: 1212 |
| KCNH2 iso a/b | NM_000238.2 | Forward Primer | GAGCGCAAAGTGGAAATCG | SEQ ID NO: 1213 |
| | | Probe | TAGGAAGCAGCTCCCATCTTTCCGGTA | SEQ ID NO: 1214 |
| | | Reverse Primer | TCTTCACGGGCACCACATC | SEQ ID NO: 1215 |
| KCNH2 iso a/c | NM_172057.1 | Forward Primer | TCCTGCTGCTGGTCATCTAC | SEQ ID NO: 1216 |
| | | Probe | TGTCTTCACACCCTACTCGGCTGC | SEQ ID NO: 1217 |
| | | Reverse Primer | CCTTCTTCCGTCTCCTTCAG | SEQ ID NO: 1218 |
| KCNK4 | NM_016611.2 | Forward Primer | CCTATCAGCCGCTGGTGT | SEQ ID NO: 1219 |
| | | Probe | ATCCTGCTCGGCCTGGCTTACTTC | SEQ ID NO: 1220 |
| | | Reverse Primer | TGGTGGTGAGCACTGAGG | SEQ ID NO: 1221 |
| KDR | NM_002253.1 | Forward Primer | GAGGACGAAGGCCTCTACAC | SEQ ID NO: 1222 |
| | | Probe | CAGGCATGCAGTGTTCTTGGCTGT | SEQ ID NO: 1223 |
| | | Reverse Primer | AAAAATGCCTCCACTTTTGC | SEQ ID NO: 1224 |
| Ki-67 | NM_002417.1 | Forward Primer | CGGACTTTGGGTGCGACTT | SEQ ID NO: 1225 |
| | | Probe | CCACTTGTCGAACCACCGCTCGT | SEQ ID NO: 1226 |
| | | Reverse Primer | TTACAACTCTTCCACTGGGACGAT | SEQ ID NO: 1227 |
| KIAA0125 | NM_014792.2 | Forward Primer | GTGTCCTGGTCCATGTGGT | SEQ ID NO: 1228 |
| | | Probe | CACGTGTCTCCACCTCCAAGGAGA | SEQ ID NO: 1229 |
| | | Reverse Primer | GGGAGGTGCACACTGAGG | SEQ ID NO: 1230 |
| KIF22 | NM_007317.1 | Forward Primer | CTAAGGCACTTGCTGGAAGG | SEQ ID NO: 1231 |
| | | Probe | TCCATAGGCAAGCACACTGGCATT | SEQ ID NO: 1232 |
| | | Reverse Primer | TCTTCCCAGCTCCTGTGG | SEQ ID NO: 1233 |
| KIF2C | NM_006845.2 | Forward Primer | AATTCCTGCTCCAAAAGAAAGTCTT | SEQ ID NO: 1234 |
| | | Probe | AAGCCGCTCCACTCGCATGTCC | SEQ ID NO: 1235 |
| | | Reverse Primer | CGTGATGCGAAGCTCTGAGA | SEQ ID NO: 1236 |
| KIFC1 | XM_371813.1 | Forward Primer | CCACAGGGTTGAAGAACCAG | SEQ ID NO: 1237 |
| | | Probe | AGCCAGTTCCTGCTGTTCCTGTCC | SEQ ID NO: 1238 |
| | | Reverse Primer | CACCTGATGTGCCAGACTTC | SEQ ID NO: 1239 |
| Kitlng | NM_000899.1 | Forward Primer | GTCCCCGGGATGGATGTT | SEQ ID NO: 1240 |
| | | Probe | CATCTCGCTTATCCAACAATGACTTGGCA | SEQ ID NO: 1241 |
| | | Reverse Primer | GATCAGTCAAGCTGTCTGACAATTG | SEQ ID NO: 1242 |
| KLF5 | NM_001730.3 | Forward Primer | GTGCAACCGCAGCTTCTC | SEQ ID NO: 1243 |
| | | Probe | CTCTGACCACCTGGCCCTGCATAT | SEQ ID NO: 1244 |
| | | Reverse Primer | CGGGCAGTGCTCAGTTCT | SEQ ID NO: 1245 |
| KLF6 | NM_001300.4 | Forward Primer | CACGAGACCGGCTACTTCTC | SEQ ID NO: 1246 |
| | | Probe | AGTACTCCTCCAGAGACGGCAGCG | SEQ ID NO: 1247 |
| | | Reverse Primer | GCTCTAGGCAGGTCTGTTGC | SEQ ID NO: 1248 |
| KLK10 | NM_002776.1 | Forward Primer | GCCCAGAGGCTCCATCGT | SEQ ID NO: 1249 |
| | | Probe | CCTCTTCCTCCCCAGTCGGCTGA | SEQ ID NO: 1250 |
| | | Reverse Primer | CAGAGGTTTGAACAGTGCAGACA | SEQ ID NO: 1251 |
| KLK6 | NM_002774.2 | Forward Primer | GACGTGAGGGTCCTGATTCT | SEQ ID NO: 1252 |
| | | Probe | TTACCCCAGCTCCATCCTTGCATC | SEQ ID NO: 1253 |
| | | Reverse Primer | TCCTCACTCATCACGTCCTC | SEQ ID NO: 1254 |
| KLRK1 | NM_007360.1 | Forward Primer | TGAGAGCCAGGCTTCTTGTA | SEQ ID NO: 1255 |
| | | Probe | TGTCTCAAAATGCCAGCCTTCTGAA | SEQ ID NO: 1256 |
| | | Reverse Primer | ATCCTGGTCCTCTTTGCTGT | SEQ ID NO: 1257 |

TABLE A-continued

| Gene | Accession | Reagent | Sequence | Sequence ID Number |
|---|---|---|---|---|
| KNTC2 | NM_006101.1 | Forward Primer<br>Probe<br>Reverse Primer | ATGTGCCAGTGAGCTTGAGT<br>CCTTGGAGAAACACAAGCACCTGC<br>TGAGCCCCTGGTTAACAGTA | SEQ ID NO: 1258<br>SEQ ID NO: 1259<br>SEQ ID NO: 1260 |
| KRAS2 | NM_004985.3 | Forward Primer<br>Probe<br>Reverse Primer | GAGACCAAGGTTGCAAGGC<br>AAGCTCAAAGGTTCACACAGGGCC<br>CAGTCCATGCTGTGAAACTCTC | SEQ ID NO: 1261<br>SEQ ID NO: 1262<br>SEQ ID NO: 1263 |
| KRT19 | NM_002276.1 | Forward Primer<br>Probe<br>Reverse Primer | TGAGCGGCAGAATCAGGAGTA<br>CTCATGGACATCAAGTCGCGGCTG<br>TGCGGTAGGTGGCAATCTC | SEQ ID NO: 1264<br>SEQ ID NO: 1265<br>SEQ ID NO: 1266 |
| KRT8 | NM_002273.1 | Forward Primer<br>Probe<br>Reverse Primer | GGATGAAGCTTACATGAACAAGGTAGA<br>CGTCGGTCAGCCCTTCCAGGC<br>CATATAGCTGCCTGAGGAAGTTGAT | SEQ ID NO: 1267<br>SEQ ID NO: 1268<br>SEQ ID NO: 1269 |
| LAMA3 | NM_000227.2 | Forward Primer<br>Probe<br>Reverse Primer | CAGATGAGGCACATGGAGAC<br>CTGATTCCTCAGGTCCTTGGCCTG<br>TTGAAATGGCAGAACGGTAG | SEQ ID NO: 1270<br>SEQ ID NO: 1271<br>SEQ ID NO: 1272 |
| LAMB3 | NM_000228.1 | Forward Primer<br>Probe<br>Reverse Primer | ACTGACCAAGCCTGAGACCT<br>CCACTCGCCATACTGGGTGCAGT<br>GTCACACTTGCAGCATTTCA | SEQ ID NO: 1273<br>SEQ ID NO: 1274<br>SEQ ID NO: 1275 |
| LAMC2 | NM_005562.1 | Forward Primer<br>Probe<br>Reverse Primer | ACTCAAGCGGAAATTGAAGCA<br>AGGTCTTATCAGCACAGTCTCCGCCTCC<br>ACTCCCTGAAGCCGAGACACT | SEQ ID NO: 1276<br>SEQ ID NO: 1277<br>SEQ ID NO: 1278 |
| LAT | NM_014387.2 | Forward Primer<br>Probe<br>Reverse Primer | GTGAACGTTCCGGAGAGC<br>ATCCAGAGACGCTTCTGCGCTCTC<br>ACATTCACATACTCCCGGCT | SEQ ID NO: 1279<br>SEQ ID NO: 1280<br>SEQ ID NO: 1281 |
| LCN2 | NM_005564.2 | Forward Primer<br>Probe<br>Reverse Primer | CGCTGGGCAACATTAAGAG<br>TCACCACTCGGACGAGGTAACTCG<br>AGCATGCTGGTTGTAGTTGGT | SEQ ID NO: 1282<br>SEQ ID NO: 1283<br>SEQ ID NO: 1284 |
| LDLRAP1 | NM_015627.1 | Forward Primer<br>Probe<br>Reverse Primer | CAGTGCCTCTCGCCTGTC<br>ACTGGGACAAGCCTGACAGCAGC<br>TGAAGAGGTCATCCTGCTCTG | SEQ ID NO: 1285<br>SEQ ID NO: 1286<br>SEQ ID NO: 1287 |
| LEF | NM_016269.2 | Forward Primer<br>Probe<br>Reverse Primer | GATGACGGAAAGCATCCAG<br>TGGAGGCCTCTACAACAAGGGACC<br>CCCGGAATAACTCGAGTAGGA | SEQ ID NO: 1288<br>SEQ ID NO: 1289<br>SEQ ID NO: 1290 |
| LGALS3 | NM_002306.1 | Forward Primer<br>Probe<br>Reverse Primer | AGCGGAAAATGGCAGACAAT<br>ACCCAGATAACGCATCATGGAGCGA<br>CTTGAGGGTTTGGGTTTCCA | SEQ ID NO: 1291<br>SEQ ID NO: 1292<br>SEQ ID NO: 1293 |
| LGMN | NM_001008530.1 | Forward Primer<br>Probe<br>Reverse Primer | TTGGTGCCGTTCCTATAGATG<br>CAGTGCTTGCCTCCATCTTCAGGA<br>GAACCTGCCACGATCACC | SEQ ID NO: 1294<br>SEQ ID NO: 1295<br>SEQ ID NO: 1296 |
| LILRB3 | NM_006864.1 | Forward Primer<br>Probe<br>Reverse Primer | CACCTGGTCTGGGAAGATACC<br>ACCGAGACCCCAATCAAAACCTCC<br>AAGAGCAGCAGGACGAAGG | SEQ ID NO: 1297<br>SEQ ID NO: 1298<br>SEQ ID NO: 1299 |
| LMNB1 | NM_005573.1 | Forward Primer<br>Probe<br>Reverse Primer | TGCAAACGCTGGTGTCACA<br>CAGCCCCCAACTGACCTCATC<br>CCCCACGAGTTCTGGTTCTTC | SEQ ID NO: 1300<br>SEQ ID NO: 1301<br>SEQ ID NO: 1302 |
| LMYC | NM_012421.1 | Forward Primer<br>Probe<br>Reverse Primer | CCCATCCAGAACACTGATTG<br>TGACCTCCATCCCTTTCACTTGAATG<br>CTGCTTTCTATGCACCCTTTC | SEQ ID NO: 1303<br>SEQ ID NO: 1304<br>SEQ ID NO: 1305 |
| LOX | NM_002317.3 | Forward Primer<br>Probe<br>Reverse Primer | CCAATGGGAGAACAACGG<br>CAGGCTCAGCAAGCTGAACACCTG<br>CGCTGAGGCTGGTACTGTG | SEQ ID NO: 1306<br>SEQ ID NO: 1307<br>SEQ ID NO: 1308 |
| LOXL2 | NM_002318.1 | Forward Primer<br>Probe<br>Reverse Primer | TCAGCGGGCTCTTAAACAA<br>CAGCTGTCCCCGCAGTAAAGAAGC<br>AAGACAGGAGTTGACCACGC | SEQ ID NO: 1309<br>SEQ ID NO: 1310<br>SEQ ID NO: 1311 |
| LRP5 | NM_002335.1 | Forward Primer<br>Probe<br>Reverse Primer | CGACTATGACCCACTGGACA<br>CGCCCATCCACCCAGTAGATGAAC<br>CTTGGCTCGCTTGATGTTC | SEQ ID NO: 1312<br>SEQ ID NO: 1313<br>SEQ ID NO: 1314 |

TABLE A-continued

| Gene | Accession | Reagent | Sequence | Sequence ID Number |
|------|-----------|---------|----------|--------------------|
| LRP6 | NM_002336.1 | Forward Primer<br>Probe<br>Reverse Primer | GGATGTAGCCATCTCTGCCT<br>ATAGACCTCAGGGCCTTCGCTGTG<br>AGTTCAAAGCCAATAGGGCA | SEQ ID NO: 1315<br>SEQ ID NO: 1316<br>SEQ ID NO: 1317 |
| LY6D | NM_003695.2 | Forward Primer<br>Probe<br>Reverse Primer | AATGCTGATGACTTGGAGCAG<br>CACAGACCCCACAGAGGATGAAGC<br>CTGCATCCTCTGTGGGGT | SEQ ID NO: 1318<br>SEQ ID NO: 1319<br>SEQ ID NO: 1320 |
| MAD | NM_002357.1 | Forward Primer<br>Probe<br>Reverse Primer | TGGTTCTGATTAGGTAACGTATTGGA<br>CTGCCCACAACTCCCTTGCACGTAA<br>GGTCAAGGTGGGACACTGAAG | SEQ ID NO: 1321<br>SEQ ID NO: 1322<br>SEQ ID NO: 1323 |
| MAD1L1 | NM_003550.1 | Forward Primer<br>Probe<br>Reverse Primer | AGAAGCTGTCCCTGCAAGAG<br>CATGTTCTTCACAATCGCTGCATCC<br>AGCCGTACCAGCTCAGACTT | SEQ ID NO: 1324<br>SEQ ID NO: 1325<br>SEQ ID NO: 1326 |
| MAD2L1 | NM_002358.2 | Forward Primer<br>Probe<br>Reverse Primer | CCGGGAGCAGGGAATCAC<br>CGGCCACGATTTCGGCGCT<br>ATGCTGTTGATGCCGAATGA | SEQ ID NO: 1327<br>SEQ ID NO: 1328<br>SEQ ID NO: 1329 |
| MADH2 | NM_005901.2 | Forward Primer<br>Probe<br>Reverse Primer | GCTGCCTTTGGTAAGAACATGTC<br>TCCATCTTGCCATTCACGCCGC<br>ATCCCAGCAGTCTCTTCACAACT | SEQ ID NO: 1330<br>SEQ ID NO: 1331<br>SEQ ID NO: 1332 |
| MADH4 | NM_005359.3 | Forward Primer<br>Probe<br>Reverse Primer | GGACATTACTGGCCTGTTCACA<br>TGCATTCCAGCCTCCCATTTCCA<br>ACCAATACTCAGGAGCAGGATGA | SEQ ID NO: 1333<br>SEQ ID NO: 1334<br>SEQ ID NO: 1335 |
| MADH7 | NM_005904.1 | Forward Primer<br>Probe<br>Reverse Primer | TCCATCAAGGCTTTCGACTA<br>CTGCAGGCTGTACGCCTTCTCG<br>CTGCTGCATAAACTCGTGGT | SEQ ID NO: 1336<br>SEQ ID NO: 1337<br>SEQ ID NO: 1338 |
| MAP2 | NM_031846.1 | Forward Primer<br>Probe<br>Reverse Primer | CGGACCACCAGGTCAGAG<br>CCACTCTTCCCTGCTCTGCGAATT<br>CAGGGGTAGTGGGTGTTGAG | SEQ ID NO: 1339<br>SEQ ID NO: 1340<br>SEQ ID NO: 1341 |
| MAP2K1 | NM_002755.2 | Forward Primer<br>Probe<br>Reverse Primer | GCCTTTCTTACCCAGAAGCAGAA<br>TCTCAAAGTCGTCATCCTTCAGTTCTCCCA<br>CAGCCCCAGCTCACTGAT | SEQ ID NO: 1342<br>SEQ ID NO: 1343<br>SEQ ID NO: 1344 |
| MAP3K1 | XM_042066.8 | Forward Primer<br>Probe<br>Reverse Primer | GGTTGGCATCAAAAGGAACT<br>AATTGTCCCTGAAACTCTCCTGCACC<br>TGCCATAAATGCAATTGTCC | SEQ ID NO: 1345<br>SEQ ID NO: 1346<br>SEQ ID NO: 1347 |
| MAPK14 | NM_139012.1 | Forward Primer<br>Probe<br>Reverse Primer | TGAGTGGAAAAGCCTGACCTATG<br>TGAAGTCATCAGCTTTGTGCCACCAC<br>GGACTCCATCTCTTCTTGGTCAA | SEQ ID NO: 1348<br>SEQ ID NO: 1349<br>SEQ ID NO: 1350 |
| Maspin | NM_002639.1 | Forward Primer<br>Probe<br>Reverse Primer | CAGATGGCCACTTTGAGAACATT<br>AGCTGACAACAGTGTGAACGACCAGACC<br>GGCAGCATTAACCACAAGGATT | SEQ ID NO: 1351<br>SEQ ID NO: 1352<br>SEQ ID NO: 1353 |
| MAX | NM_002382.3 | Forward Primer<br>Probe<br>Reverse Primer | CAAACGGGCTCATCATAATGC<br>TGATGTGGTCCCTACGTTTTCGTTCCA<br>TCCCGCAAACTGTGAAAGCT | SEQ ID NO: 1354<br>SEQ ID NO: 1355<br>SEQ ID NO: 1356 |
| MCM2 | NM_004526.1 | Forward Primer<br>Probe<br>Reverse Primer | GACTTTTGCCCGCTACCTTTC<br>ACAGCTCATTGTTGTCACGCCGGA<br>GCCACTAACTGCTTCAGTATGAAGAG | SEQ ID NO: 1357<br>SEQ ID NO: 1358<br>SEQ ID NO: 1359 |
| MCM3 | NM_002388.2 | Forward Primer<br>Probe<br>Reverse Primer | GGAGAACAATCCCCTTGAGA<br>TGGCCTTTCTGTCTACAAGGATCACCA<br>ATCTCCTGGATGGTGATGGT | SEQ ID NO: 1360<br>SEQ ID NO: 1361<br>SEQ ID NO: 1362 |
| MCM6 | NM_005915.2 | Forward Primer<br>Probe<br>Reverse Primer | TGATGGTCCTATGTGTCACATTCA<br>CAGGTTTCATACCAACACAGGCTTCAGCAC<br>TGGGACAGGAAACACACCAA | SEQ ID NO: 1363<br>SEQ ID NO: 1364<br>SEQ ID NO: 1365 |
| MCP1 | NM_002982.1 | Forward Primer<br>Probe<br>Reverse Primer | CGCTCAGCCAGATGCAATC<br>TGCCCCAGTCACCTGCTGTTA<br>GCACTGAGATCTTCCTATTGGTGAA | SEQ ID NO: 1366<br>SEQ ID NO: 1367<br>SEQ ID NO: 1368 |
| MDK | NM_002391.2 | Forward Primer<br>Probe<br>Reverse Primer | GGAGCCGACTGCAAGTACA<br>ATCACACGCACCCCAGTTCTCAAA<br>GACTTTGGTGCCTGTGCC | SEQ ID NO: 1369<br>SEQ ID NO: 1370<br>SEQ ID NO: 1371 |

TABLE A-continued

| Gene | Accession | Reagent | Sequence | Sequence ID Number |
|---|---|---|---|---|
| MDM2 | NM_002392.1 | Forward Primer<br>Probe<br>Reverse Primer | CTACAGGGACGCCATCGAA<br>CTTACACCAGCATCAAGATCCGG<br>ATCCAACCAATCACCTGAATGTT | SEQ ID NO: 1372<br>SEQ ID NO: 1373<br>SEQ ID NO: 1374 |
| MGAT5 | NM_002410.2 | Forward Primer<br>Probe<br>Reverse Primer | GGAGTCGAAGGTGGACAATC<br>AATGGCACCGGAACAAACTCAACC<br>TGGGAACAGCTGTAGTGGAGT | SEQ ID NO: 1375<br>SEQ ID NO: 1376<br>SEQ ID NO: 1377 |
| MGMT | NM_002412.1 | Forward Primer<br>Probe<br>Reverse Primer | GTGAAATGAAACGCACCACA<br>CAGCCCTTTGGGGAAGCTGG<br>GACCCTGCTCACAACCAGAC | SEQ ID NO: 1378<br>SEQ ID NO: 1379<br>SEQ ID NO: 1380 |
| mGST1 | NM_020300.2 | Forward Primer<br>Probe<br>Reverse Primer | ACGGATCTACCACACCATTGC<br>TTTGACACCCCTTCCCCAGCCA<br>TCCATATCCAACAAAAAAACTCAAAG | SEQ ID NO: 1381<br>SEQ ID NO: 1382<br>SEQ ID NO: 1383 |
| MMP1 | NM_002421.2 | Forward Primer<br>Probe<br>Reverse Primer | GGGAGATCATCGGGACAACTC<br>AGCAAGATTTCCTCCAGGTCCATCAAAAGG<br>GGGCCTGGTTGAAAAGCAT | SEQ ID NO: 1384<br>SEQ ID NO: 1385<br>SEQ ID NO: 1386 |
| MMP12 | NM_002426.1 | Forward Primer<br>Probe<br>Reverse Primer | CCAACGCTTGCCAAATCCT<br>AACCAGCTCTCTGTGACCCCAATT<br>ACGGTAGTGACAGCATCAAAACTC | SEQ ID NO: 1387<br>SEQ ID NO: 1388<br>SEQ ID NO: 1389 |
| MMP2 | NM_004530.1 | Forward Primer<br>Probe<br>Reverse Primer | CCATGATGGAGAGGCAGACA<br>CTGGGAGCATGGCGATGGATACCC<br>GGAGTCCGTCCTTACCGTCAA | SEQ ID NO: 1390<br>SEQ ID NO: 1391<br>SEQ ID NO: 1392 |
| MMP7 | NM_002423.2 | Forward Primer<br>Probe<br>Reverse Primer | GGATGGTAGCAGTCTAGGGATTAACT<br>CCTGTATGCTGCAACTCATGAACTTGGC<br>GGAATGTCCCATACCCAAAGAA | SEQ ID NO: 1393<br>SEQ ID NO: 1394<br>SEQ ID NO: 1395 |
| MMP9 | NM_004994.1 | Forward Primer<br>Probe<br>Reverse Primer | GAGAACCAATCTCACCGACA<br>ACAGGTATTCCTCTGCCAGCTGCC<br>CACCCGAGTGTAACCATAGC | SEQ ID NO: 1396<br>SEQ ID NO: 1397<br>SEQ ID NO: 1398 |
| MRP1 | NM_004996.2 | Forward Primer<br>Probe<br>Reverse Primer | TCATGGTGCCCGTCAATG<br>ACCTGATACGTCTTGGTCTTCATCGCCAT<br>CGATTGTCTTTGCTCTTCATGTG | SEQ ID NO: 1399<br>SEQ ID NO: 1400<br>SEQ ID NO: 1401 |
| MRP2 | NM_000392.1 | Forward Primer<br>Probe<br>Reverse Primer | AGGGGATGACTTGGACACAT<br>CTGCCATTCGACATGACTGCAATTT<br>AAAACTGCATGGCTTTGTCA | SEQ ID NO: 1402<br>SEQ ID NO: 1403<br>SEQ ID NO: 1404 |
| MRP3 | NM_003786.2 | Forward Primer<br>Probe<br>Reverse Primer | TCATCCTGGCGATCTACTTCCT<br>TCTGTCCTGGCTGGAGTCGCTTTCAT<br>CCGTTGAGTGGAATCAGCAA | SEQ ID NO: 1405<br>SEQ ID NO: 1406<br>SEQ ID NO: 1407 |
| MRP4 | NM_005845.1 | Forward Primer<br>Probe<br>Reverse Primer | AGCGCCTGGAATCTACAACT<br>CGGAGTCCAGTGTTTTCCCACTTG<br>AGAGCCCCTGGAGAGAAGAT | SEQ ID NO: 1408<br>SEQ ID NO: 1409<br>SEQ ID NO: 1410 |
| MRPL40 | NM_003776.2 | Forward Primer<br>Probe<br>Reverse Primer | ACTTGCAGGCTGCTATCCTT<br>TTCCTACTCTCAGGGGCAGCATGTT<br>AGCAGACTTGAACCCTGGTC | SEQ ID NO: 1411<br>SEQ ID NO: 1412<br>SEQ ID NO: 1413 |
| MSH2 | NM_000251.1 | Forward Primer<br>Probe<br>Reverse Primer | GATGCAGAATTGAGGCAGAC<br>CAAGAAGATTTACTTCGTCGATTCCCAGA<br>TCTTGGCAAGTCGGTTAAGA | SEQ ID NO: 1414<br>SEQ ID NO: 1415<br>SEQ ID NO: 1416 |
| MSH3 | NM_002439.1 | Forward Primer<br>Probe<br>Reverse Primer | TGATTACCATCATGGCTCAGA<br>TCCCAATTGTCGCTTCTTCTGCAG<br>CTTGTGAAAATGCCATCCAC | SEQ ID NO: 1417<br>SEQ ID NO: 1418<br>SEQ ID NO: 1419 |
| MSH6 | NM_000179.1 | Forward Primer<br>Probe<br>Reverse Primer | TCTATTGGGGATTGGTAGG<br>CCGTTACCAGCTGGAAATTCCTGAGA<br>CAAATTGCGAGTGGTGAAAT | SEQ ID NO: 1420<br>SEQ ID NO: 1421<br>SEQ ID NO: 1422 |
| MT3 | NM_005954.1 | Forward Primer<br>Probe<br>Reverse Primer | GTGTGAGAAGTGTGCCAAGG<br>CTCTCCGCCTTTGCACACACAGT<br>CTGCACTTCTCTGCTTCTGC | SEQ ID NO: 1423<br>SEQ ID NO: 1424<br>SEQ ID NO: 1425 |
| MTA1 | NM_004689.2 | Forward Primer<br>Probe<br>Reverse Primer | CCGCCCTCACCTGAAGAGA<br>CCCAGTGTCCGCCAAGGAGCG<br>GGAATAAGTTAGCCGCGCTTCT | SEQ ID NO: 1426<br>SEQ ID NO: 1427<br>SEQ ID NO: 1428 |

TABLE A-continued

| Gene | Accession | Reagent | Sequence | Sequence ID Number |
| --- | --- | --- | --- | --- |
| MUC1 | NM_002456.1 | Forward Primer | GGCCAGGATCTGTGGTGGTA | SEQ ID NO: 1429 |
| | | Probe | CTCTGGCCTTCCGAGAAGGTACC | SEQ ID NO: 1430 |
| | | Reverse Primer | CTCCACGTCGTGGACATTGA | SEQ ID NO: 1431 |
| MUC2 | NM_002457.1 | Forward Primer | CTATGAGCCATGTGGGAACC | SEQ ID NO: 1432 |
| | | Probe | AGCTTCGAGACCTGCAGGACCATC | SEQ ID NO: 1433 |
| | | Reverse Primer | ATGTTGGAGTGGATGCCG | SEQ ID NO: 1434 |
| MUC5B | XM_039877.11 | Forward Primer | TGCCCTTGCACTGTCCTAA | SEQ ID NO: 1435 |
| | | Probe | TCAGCCATCCTGCACACCTACACC | SEQ ID NO: 1436 |
| | | Reverse Primer | CAGCCACACTCATCCACG | SEQ ID NO: 1437 |
| MUTYH | NM_012222.1 | Forward Primer | GTACGACCAAGAGAAACGGG | SEQ ID NO: 1438 |
| | | Probe | TCTGCCCGTCTTCTCCATGGTAGG | SEQ ID NO: 1439 |
| | | Reverse Primer | CCTGTCCAGGTCCATCTCA | SEQ ID NO: 1440 |
| MVP | NM_017458.1 | Forward Primer | ACGAGAACGAGGGCATCTATGT | SEQ ID NO: 1441 |
| | | Probe | CGCACCTTTCCGGTCTTGACATCCT | SEQ ID NO: 1442 |
| | | Reverse Primer | GCATGTAGGTGCTTCCAATCAC | SEQ ID NO: 1443 |
| MX1 | NM_002462.2 | Forward Primer | GAAGGAATGGGAATCAGTCATGA | SEQ ID NO: 1444 |
| | | Probe | TCACCCTGGAGATCAGCTCCCGA | SEQ ID NO: 1445 |
| | | Reverse Primer | GTCTATTAGAGTCAGATCCGGGACAT | SEQ ID NO: 1446 |
| MXD4 | NM_006454.2 | Forward Primer | AGAAACTGGAGGAGCAGGAC | SEQ ID NO: 1447 |
| | | Probe | TGCAGCTGCTCCTTGATGCTCAGT | SEQ ID NO: 1448 |
| | | Reverse Primer | CTTCAGGAAACGATGCTCCT | SEQ ID NO: 1449 |
| MYBL2 | NM_002466.1 | Forward Primer | GCCGAGATCGCCAAGATG | SEQ ID NO: 1450 |
| | | Probe | CAGCATTGTCTGTCCTCCCTGGCA | SEQ ID NO: 1451 |
| | | Reverse Primer | CTTTTGATGGTAGAGTTCCAGTGATTC | SEQ ID NO: 1452 |
| MYH11 | NM_002474.1 | Forward Primer | CGGTACTTCTCAGGGCTAATATATACG | SEQ ID NO: 1453 |
| | | Probe | CTCTTCTGCGTGGTGGTCAACCCCTA | SEQ ID NO: 1454 |
| | | Reverse Primer | CCGAGTAGATGGGCAGGTGTT | SEQ ID NO: 1455 |
| MYLK | NM_053025.1 | Forward Primer | TGACGGAGCGTGAGTGCAT | SEQ ID NO: 1456 |
| | | Probe | CCCTCCGAGATCTGCCGCATGTACT | SEQ ID NO: 1457 |
| | | Reverse Primer | ATGCCCTGCTTGTGGATGTAC | SEQ ID NO: 1458 |
| NAT2 | NM_000015.1 | Forward Primer | TAACTGACATTCTTGAGCACCAGAT | SEQ ID NO: 1459 |
| | | Probe | CGGGCTGTTCCCTTTGAGAACCTTAACA | SEQ ID NO: 1460 |
| | | Reverse Primer | ATGGCTTGCCCACAATGC | SEQ ID NO: 1461 |
| NAV2 | NM_182964.3 | Forward Primer | CTCTCCCAGCACAGCTTGA | SEQ ID NO: 1462 |
| | | Probe | CCTCACTGAGTCAACCAGCCTGGA | SEQ ID NO: 1463 |
| | | Reverse Primer | CACCAGTGTCATCCAGCAAC | SEQ ID NO: 1464 |
| NCAM1 | NM_000615.1 | Forward Primer | TAGTTCCCAGCTGACCATCA | SEQ ID NO: 1465 |
| | | Probe | CTCAGCCTCGTCGTTCTTATCCACC | SEQ ID NO: 1466 |
| | | Reverse Primer | CAGCCTTGTTCTCAGCAATG | SEQ ID NO: 1467 |
| NDE1 | NM_017668.1 | Forward Primer | CTACTGCGGAAAGTCGGG | SEQ ID NO: 1468 |
| | | Probe | CTGGAGTCCAAACTCGCTTCCTGC | SEQ ID NO: 1469 |
| | | Reverse Primer | GGACTGATCGTACACGAGGTT | SEQ ID NO: 1470 |
| NDRG1 | NM_006096.2 | Forward Primer | AGGGCAACATTCCACAGC | SEQ ID NO: 1471 |
| | | Probe | CTGCAAGGACACTCATCACAGCCA | SEQ ID NO: 1472 |
| | | Reverse Primer | CAGTGCTCCTACTCCGGC | SEQ ID NO: 1473 |
| NDUFS3 | NM_004551.1 | Forward Primer | TATCCATCCTGATGGCGTC | SEQ ID NO: 1474 |
| | | Probe | CCCAGTGCTGACTTTCCTCAGGGA | SEQ ID NO: 1475 |
| | | Reverse Primer | TTGAACTGTGCATTGGTGTG | SEQ ID NO: 1476 |
| NEDD8 | NM_006156.1 | Forward Primer | TGCTGGCTACTGGGTGTTAGT | SEQ ID NO: 1477 |
| | | Probe | TGCAGTCCTGTGTGCTTCCCTCTC | SEQ ID NO: 1478 |
| | | Reverse Primer | GACAACCAGGGACACAGTCA | SEQ ID NO: 1479 |
| NEK2 | NM_002497.1 | Forward Primer | GTGAGGCAGCGCGACTCT | SEQ ID NO: 1480 |
| | | Probe | TGCCTTCCCGGGCTGAGGACT | SEQ ID NO: 1481 |
| | | Reverse Primer | TGCCAATGGTGTACAACACTTCA | SEQ ID NO: 1482 |
| NF2 | NM_000268.2 | Forward Primer | ACTCCAGAGCTGACCTCCAC | SEQ ID NO: 1483 |
| | | Probe | CTACAATGACTTCCCAGGCTGGGC | SEQ ID NO: 1484 |
| | | Reverse Primer | TCAGGGCTTCAGTGTCTCAC | SEQ ID NO: 1485 |

TABLE A-continued

| Gene | Accession | Reagent | Sequence | Sequence ID Number |
|---|---|---|---|---|
| NFKBp50 | NM_003998.1 | Forward Primer | CAGACCAAGGAGATGGACCT | SEQ ID NO: 1486 |
| | | Probe | AAGCTGTAAACATGAGCCGCACCA | SEQ ID NO: 1487 |
| | | Reverse Primer | AGCTGCCAGTGCTATCCG | SEQ ID NO: 1488 |
| NFKBp65 | NM_021975.1 | Forward Primer | CTGCCGGGATGGCTTCTAT | SEQ ID NO: 1489 |
| | | Probe | CTGAGCTCTGCCCGGACCGCT | SEQ ID NO: 1490 |
| | | Reverse Primer | CCAGGTTCTGGAAACTGTGGAT | SEQ ID NO: 1491 |
| NISCH | NM_007184.1 | Forward Primer | CCAAGGAATCATGTTCGTTCAG | SEQ ID NO: 1492 |
| | | Probe | TGGCCAGCAGCCTCTCGTCCAC | SEQ ID NO: 1493 |
| | | Reverse Primer | TGGTGCTCGGGAGTCAGACT | SEQ ID NO: 1494 |
| Nkd-1 | NM_033119.3 | Forward Primer | GAGAGAGTGAGCGAACCCTG | SEQ ID NO: 1495 |
| | | Probe | CCAGGCTCCAAGAAGCAGCTGAAG | SEQ ID NO: 1496 |
| | | Reverse Primer | CGTCGCACTGGAGCTCTT | SEQ ID NO: 1497 |
| NMB | NM_021077.1 | Forward Primer | GGCTGCTGGTACAAATACTGC | SEQ ID NO: 1498 |
| | | Probe | TGTCTGCCCCTATTATTGGTGTCATTTCT | SEQ ID NO: 1499 |
| | | Reverse Primer | CAATCTAAGCCACGCTGTTG | SEQ ID NO: 1500 |
| NMBR | NM_002511.1 | Forward Primer | TGATCCATCTCTAGGCCACA | SEQ ID NO: 1501 |
| | | Probe | TTGTCACCTTAGTTGCCCGGGTTC | SEQ ID NO: 1502 |
| | | Reverse Primer | GAGCAAATGGGTTGACACAA | SEQ ID NO: 1503 |
| NME1 | NM_000269.1 | Forward Primer | CCAACCCTGCAGACTCCAA | SEQ ID NO: 1504 |
| | | Probe | CCTGGGACCATCCGTGGAGACTTCT | SEQ ID NO: 1505 |
| | | Reverse Primer | ATGTATAATGTTCCTGCCAACTTGTATG | SEQ ID NO: 1506 |
| NOS3 | NM_000603.2 | Forward Primer | ATCTCCGCCTCGCTCATG | SEQ ID NO: 1507 |
| | | Probe | TTCACTCGCTTCGCCATCACCG | SEQ ID NO: 1508 |
| | | Reverse Primer | TCGGAGCCATACAGGATTGTC | SEQ ID NO: 1509 |
| NOTCH1 | NM_017617.2 | Forward Primer | CGGGTCCACCAGTTTGAATG | SEQ ID NO: 1510 |
| | | Probe | CCGCTCTGCAGCCGGGACA | SEQ ID NO: 1511 |
| | | Reverse Primer | GTTGTATTGGTTCGGCACCAT | SEQ ID NO: 1512 |
| NOTCH2 | NM_024408.2 | Forward Primer | CACTTCCCTGCTGGGATTAT | SEQ ID NO: 1513 |
| | | Probe | CCGTGTTGCACAGCTCATCACACT | SEQ ID NO: 1514 |
| | | Reverse Primer | AGTTGTCAAACAGGCACTCG | SEQ ID NO: 1515 |
| NPM1 | NM_002520.2 | Forward Primer | AATGTTGTCCAGGTTCTATTGC | SEQ ID NO: 1516 |
| | | Probe | AACAGGCATTTTGGACAACACATTCTTG | SEQ ID NO: 1517 |
| | | Reverse Primer | CAAGCAAAGGGTGGAGTTC | SEQ ID NO: 1518 |
| NR4A1 | NM_002135.2 | Forward Primer | CACAGCTTGCTTGTCGATGTC | SEQ ID NO: 1519 |
| | | Probe | CCTTCGCCTGCCTCTCTGCCC | SEQ ID NO: 1520 |
| | | Reverse Primer | ATGCCGGTCGGTGATGAG | SEQ ID NO: 1521 |
| NRG1 | NM_013957.1 | Forward Primer | CGAGACTCTCCTCATAGTGAAAGGTAT | SEQ ID NO: 1522 |
| | | Probe | ATGACCACCCGGCTCGTATGTCA | SEQ ID NO: 1523 |
| | | Reverse Primer | CTTGGCGTGTGGAAATCTACAG | SEQ ID NO: 1524 |
| NRP1 | NM_003873.1 | Forward Primer | CAGCTCTCTCCACGCGATTC | SEQ ID NO: 1525 |
| | | Probe | CAGGATCTACCCCGAGAGAGCCACTCAT | SEQ ID NO: 1526 |
| | | Reverse Primer | CCCAGCAGCTCCATTCTGA | SEQ ID NO: 1527 |
| NRP2 | NM_003872.1 | Forward Primer | CTACAGCCTAAACGGCAAGG | SEQ ID NO: 1528 |
| | | Probe | AGGACCCCAGGACCCAGCAG | SEQ ID NO: 1529 |
| | | Reverse Primer | GTTCCCTTCGAACAGCTTTG | SEQ ID NO: 1530 |
| NTN1 | NM_004822.1 | Forward Primer | AGAAGGACTATGCCGTCCAG | SEQ ID NO: 1531 |
| | | Probe | ATCCACATCCTGAAGGCGGACAAG | SEQ ID NO: 1532 |
| | | Reverse Primer | CCGTGAACTTCCACCAGTC | SEQ ID NO: 1533 |
| NUFIP1 | NM_012345.1 | Forward Primer | GCTTCCACATCGTGGTATTG | SEQ ID NO: 1534 |
| | | Probe | CTTCTGATAGGTTTCCTCGGCATCAGA | SEQ ID NO: 1535 |
| | | Reverse Primer | AACTGCAGGGTTGAAGGACT | SEQ ID NO: 1536 |
| ODC1 | NM_002539.1 | Forward Primer | AGAGATCACCGGCGTAATCAA | SEQ ID NO: 1537 |
| | | Probe | CCAGCGTTGGACAAATACTTTCCGTCA | SEQ ID NO: 1538 |
| | | Reverse Primer | CGGGCTCAGCTATGATTCTCA | SEQ ID NO: 1539 |

TABLE A-continued

| Gene | Accession | Reagent | Sequence | Sequence ID Number |
|---|---|---|---|---|
| OPN, osteopontin | NM_000582.1 | Forward Primer | CAACCGAAGTTTTCACTCCAGTT | SEQ ID NO: 1540 |
| | | Probe | TCCCCACAGTAGACACATATGATGGCCG | SEQ ID NO: 1541 |
| | | Reverse Primer | CCTCAGTCCATAAACCACACTATCA | SEQ ID NO: 1542 |
| ORC1L | NM_004153.2 | Forward Primer | TCCTTGACCATACCGGAGG | SEQ ID NO: 1543 |
| | | Probe | TGCATGTACATCTCCGGTGTCCCT | SEQ ID NO: 1544 |
| | | Reverse Primer | CAGTGGCAGTCTTCCCTGTC | SEQ ID NO: 1545 |
| OSM | NM_020530.3 | Forward Primer | GTTTCTGAAGGGGAGGTCAC | SEQ ID NO: 1546 |
| | | Probe | CTGAGCTGGCCTCCTATGCCTCAT | SEQ ID NO: 1547 |
| | | Reverse Primer | AGGTGTCTGGTTTGGGACA | SEQ ID NO: 1548 |
| OSMR | NM_003999.1 | Forward Primer | GCTCATCATGGTCATGTGCT | SEQ ID NO: 1549 |
| | | Probe | CAGGTCTCCTTGATCCACTGACTTTTCA | SEQ ID NO: 1550 |
| | | Reverse Primer | TGTAAGGGTCAGGGATGTCA | SEQ ID NO: 1551 |
| P14ARF | S78535.1 | Forward Primer | CCCTCGTGCTGATGCTACT | SEQ ID NO: 1552 |
| | | Probe | CTGCCCTAGACGCTGGCTCCTC | SEQ ID NO: 1553 |
| | | Reverse Primer | CATCATGACCTGGTCTTCTAGG | SEQ ID NO: 1554 |
| p16-INK4 | L27211.1 | Forward Primer | GCGGAAGGTCCCTCAGACA | SEQ ID NO: 1555 |
| | | Probe | CTCAGAGCCTCTCTGGTTCTTTCAATCGG | SEQ ID NO: 1556 |
| | | Reverse Primer | TGATGATCTAAGTTTCCCGAGGTT | SEQ ID NO: 1557 |
| p21 | NM_000389.1 | Forward Primer | TGGAGACTCTCAGGGTCGAAA | SEQ ID NO: 1558 |
| | | Probe | CGGCGGCAGACCAGCATGAC | SEQ ID NO: 1559 |
| | | Reverse Primer | GGCGTTTGGAGTGGTAGAAATC | SEQ ID NO: 1560 |
| p27 | NM_004064.1 | Forward Primer | CGGTGGACCACGAAGAGTTAA | SEQ ID NO: 1561 |
| | | Probe | CCGGGACTTGGAGAAGCACTGCA | SEQ ID NO: 1562 |
| | | Reverse Primer | GGCTCGCCTCTTCCATGTC | SEQ ID NO: 1563 |
| P53 | NM_000546.2 | Forward Primer | CTTTGAACCCTTGCTTGCAA | SEQ ID NO: 1564 |
| | | Probe | AAGTCCTGGGTGCTTCTGACGCACA | SEQ ID NO: 1565 |
| | | Reverse Primer | CCCGGGACAAAGCAAATG | SEQ ID NO: 1566 |
| p53R2 | AB036063.1 | Forward Primer | CCCAGCTAGTGTTCCTCAGA | SEQ ID NO: 1567 |
| | | Probe | TCGGCCAGCTTTTTCCAATCTTTG | SEQ ID NO: 1568 |
| | | Reverse Primer | CCGTAAGCCCTTCCTCTATG | SEQ ID NO: 1569 |
| PADI4 | NM_012387.1 | Forward Primer | AGCAGTGGCTTGCTTTCTTC | SEQ ID NO: 1570 |
| | | Probe | CCTGTGATGTCCCAGTTTCCCACTC | SEQ ID NO: 1571 |
| | | Reverse Primer | TGCTAGGACCATGTTGGGAT | SEQ ID NO: 1572 |
| PAI1 | NM_000602.1 | Forward Primer | CCGCAACGTGGTTTTCTCA | SEQ ID NO: 1573 |
| | | Probe | CTCGGTGTTGGCCATGCTCCAG | SEQ ID NO: 1574 |
| | | Reverse Primer | TGCTGGGTTTCTCCTCCTGTT | SEQ ID NO: 1575 |
| Pak1 | NM_002576.3 | Forward Primer | GAGCTGTGGGTTGTTATGGA | SEQ ID NO: 1576 |
| | | Probe | ACATCTGTCAAGGAGCCTCCAGCC | SEQ ID NO: 1577 |
| | | Reverse Primer | CCATGCAAGTTTCTGTCACC | SEQ ID NO: 1578 |
| PARC | NM_015089.1 | Forward Primer | GGAGCTGACCTGCTTCCTAC | SEQ ID NO: 1579 |
| | | Probe | TCCTTATGCATCGAGGCCAGGC | SEQ ID NO: 1580 |
| | | Reverse Primer | AGCAGAGCACCACAGCATAG | SEQ ID NO: 1581 |
| PCAF | NM_003884.3 | Forward Primer | AGGTGGCTGTGTTACTGCAA | SEQ ID NO: 1582 |
| | | Probe | TGCCACAGTTCTGCGACAGTCTACC | SEQ ID NO: 1583 |
| | | Reverse Primer | CACCTGTGTGGTTTCGTACC | SEQ ID NO: 1584 |
| PCNA | NM_002592.1 | Forward Primer | GAAGGTGTTGGAGGCACTCAAG | SEQ ID NO: 1585 |
| | | Probe | ATCCCAGCAGGCCTCGTTGATGAG | SEQ ID NO: 1586 |
| | | Reverse Primer | GGTTTACACCGCTGGAGCTAA | SEQ ID NO: 1587 |
| PDGFA | NM_002607.2 | Forward Primer | TTGTTGGTGTGCCCTGGTG | SEQ ID NO: 1588 |
| | | Probe | TGGTGGCGGTCACTCCCTCTGC | SEQ ID NO: 1589 |
| | | Reverse Primer | TGGGTTCTGTCCAAACACTGG | SEQ ID NO: 1590 |
| PDGFB | NM_002608.1 | Forward Primer | ACTGAAGGAGACCCTTGGAG | SEQ ID NO: 1591 |
| | | Probe | TCTCCTGCCGATGCCCTAGG | SEQ ID NO: 1592 |
| | | Reverse Primer | TAAATAACCCTGCCCACACA | SEQ ID NO: 1593 |

TABLE A-continued

| Gene | Accession | Reagent | Sequence | Sequence ID Number |
|---|---|---|---|---|
| PDGFC | NM_016205.1 | Forward Primer<br>Probe<br>Reverse Primer | AGTTACTAAAAAATACCACGAGGTCCTT<br>CCCTGACACCGGTCTTTGGTCTCAACT<br>GTCGGTGAGTGATTTGTGCAA | SEQ ID NO: 1594<br>SEQ ID NO: 1595<br>SEQ ID NO: 1596 |
| PDGFD | NM_025208.2 | Forward Primer<br>Probe<br>Reverse Primer | TATCGAGGCAGGTCATACCA<br>TCCAGGTCAACTTTTGACTTCCGGT<br>TAACGCTTGGCATCATCATT | SEQ ID NO: 1597<br>SEQ ID NO: 1598<br>SEQ ID NO: 1599 |
| PDGFRa | NM_006206.2 | Forward Primer<br>Probe<br>Reverse Primer | GGGAGTTTCCAAGAGATGGA<br>CCCAAGACCCGACCAAGCACTAG<br>CTTCAACCACCTTCCCAAAC | SEQ ID NO: 1600<br>SEQ ID NO: 1601<br>SEQ ID NO: 1602 |
| PDGFRb | NM_002609.2 | Forward Primer<br>Probe<br>Reverse Primer | CCAGCTCTCCTTCCAGCTAC<br>ATCAATGTCCCTGTCCGAGTGCTG<br>GGGTGGCTCTCACTTAGCTC | SEQ ID NO: 1603<br>SEQ ID NO: 1604<br>SEQ ID NO: 1605 |
| PFN1 | NM_005022.2 | Forward Primer<br>Probe<br>Reverse Primer | GGAAAACGTTCGTCAACATC<br>CAACCAGGACACCCACCTCAGCT<br>AAAACTTGACCGGTCTTTGC | SEQ ID NO: 1606<br>SEQ ID NO: 1607<br>SEQ ID NO: 1608 |
| PFN2 | NM_053024.1 | Forward Primer<br>Probe<br>Reverse Primer | TCTATACGTCGATGGTGACTGC<br>CTCCCCACCTTGACTCTTTGTCCG<br>GCCGACAGCCACATTGTAT | SEQ ID NO: 1609<br>SEQ ID NO: 1610<br>SEQ ID NO: 1611 |
| PGK1 | NM_000291.1 | Forward Primer<br>Probe<br>Reverse Primer | AGAGCCAGTTGCTGTAGAACTCAA<br>TCTCTGCTGGGCAAGGATGTTCTGTTC<br>CTGGGCCTACACAGTCCTTCA | SEQ ID NO: 1612<br>SEQ ID NO: 1613<br>SEQ ID NO: 1614 |
| PI3K | NM_002646.2 | Forward Primer<br>Probe<br>Reverse Primer | TGCTACCTGGACAGCCCG<br>TCCTCCTGAAACGAGCTGTGTCTGACTT<br>AGGCCGTCCTTCAGTAACCA | SEQ ID NO: 1615<br>SEQ ID NO: 1616<br>SEQ ID NO: 1617 |
| PI3KC2A | NM_002645.1 | Forward Primer<br>Probe<br>Reverse Primer | ATACCAATCACCGCACAAACC<br>TGCGCTGTGACTGGACTTAACAAATAGCCT<br>CACACTAGCATTTTCTCCGCATA | SEQ ID NO: 1618<br>SEQ ID NO: 1619<br>SEQ ID NO: 1620 |
| PIK3CA | NM_006218.1 | Forward Primer<br>Probe<br>Reverse Primer | GTGATTGAAGAGCATGCCAA<br>TCCTGCTTCTCGGGATACAGACCA<br>GTCCTGCGTGGGAATAGC | SEQ ID NO: 1621<br>SEQ ID NO: 1622<br>SEQ ID NO: 1623 |
| PIM1 | NM_002648.2 | Forward Primer<br>Probe<br>Reverse Primer | CTGCTCAAGGACACCGTCTA<br>TACACTCGGGTCCCATCGAAGTCC<br>GGATCCACTCTGGAGGGC | SEQ ID NO: 1624<br>SEQ ID NO: 1625<br>SEQ ID NO: 1626 |
| Pin1 | NM_006221.1 | Forward Primer<br>Probe<br>Reverse Primer | GATCAACGGCTACATCCAGA<br>TCAAAGTCCTCCTCTCCCGACTTGA<br>TGAACTGTGAGGCCAGAGAC | SEQ ID NO: 1627<br>SEQ ID NO: 1628<br>SEQ ID NO: 1629 |
| PKD1 | NM_000296.2 | Forward Primer<br>Probe<br>Reverse Primer | CAGCACCAGCGATTACGAC<br>AGCCATTGTGAGGACTCTCCCAGC<br>CTGAATAGGCCCACGTCC | SEQ ID NO: 1630<br>SEQ ID NO: 1631<br>SEQ ID NO: 1632 |
| PKR2 | NM_002654.3 | Forward Primer<br>Probe<br>Reverse Primer | CCGCCTGGACATTGATTCAC<br>ACCCATCACAGCCCGGAACACTG<br>CTGGGCCAATGGTACAGATGA | SEQ ID NO: 1633<br>SEQ ID NO: 1634<br>SEQ ID NO: 1635 |
| PLA2G2A | NM_000300.2 | Forward Primer<br>Probe<br>Reverse Primer | GCATCCCTCACCCATCCTA<br>AGGCCAGGCAGGAGCCCTTCTATA<br>GCTGGAAATCTGCTGGATGT | SEQ ID NO: 1636<br>SEQ ID NO: 1637<br>SEQ ID NO: 1638 |
| PLAUR | NM_002659.1 | Forward Primer<br>Probe<br>Reverse Primer | CCCATGGATGCTCCTCTGAA<br>CATTGACTGCCGAGGCCCCATG<br>CCGGTGGCTACCAGACATTG | SEQ ID NO: 1639<br>SEQ ID NO: 1640<br>SEQ ID NO: 1641 |
| PLK | NM_005030.2 | Forward Primer<br>Probe<br>Reverse Primer | AATGAATACAGTATTCCCAAGCACAT<br>AACCCCGTGGCCGCCTCC<br>TGTCTGAAGCATCTTCTGGATGA | SEQ ID NO: 1642<br>SEQ ID NO: 1643<br>SEQ ID NO: 1644 |
| PLK3 | NM_004073.2 | Forward Primer<br>Probe<br>Reverse Primer | TGAAGGAGACGTACCGCTG<br>CAAGCAGGTTCACTACACGCTGCC<br>CAGGCAGTGAGAGGCTGG | SEQ ID NO: 1645<br>SEQ ID NO: 1646<br>SEQ ID NO: 1647 |
| PLOD2 | NM_000935.2 | Forward Primer<br>Probe<br>Reverse Primer | CAGGGAGGTGGTTGCAAAT<br>TCCAGCCTTTTCGTGGTGACTCAA<br>TCTCCCAGGATGCATGAAG | SEQ ID NO: 1648<br>SEQ ID NO: 1649<br>SEQ ID NO: 1650 |

TABLE A-continued

| Gene | Accession | Reagent | Sequence | Sequence ID Number |
|---|---|---|---|---|
| PMS1 | NM_000534.2 | Forward Primer<br>Probe<br>Reverse Primer | CTTACGGTTTTCGTGGAGAAG<br>CCTCAGCTATACAACAAATTGACCCCAAG<br>AGCAGCCGTTCTTGTTGTAA | SEQ ID NO: 1651<br>SEQ ID NO: 1652<br>SEQ ID NO: 1653 |
| PMS2 | NM_000535.2 | Forward Primer<br>Probe<br>Reverse Primer | GATGTGGACTGCCATTCAAA<br>TCGAAATTTACATCCGGTATCTTCCTGG<br>TGCGAGATTAGTTGGCTGAG | SEQ ID NO: 1654<br>SEQ ID NO: 1655<br>SEQ ID NO: 1656 |
| PPARG | NM_005037.3 | Forward Primer<br>Probe<br>Reverse Primer | TGACTTTATGGAGCCCAAGTT<br>TTCCAGTGCATTGAACTTCACAGCA<br>GCCAAGTCGCTGTCATCTAA | SEQ ID NO: 1657<br>SEQ ID NO: 1658<br>SEQ ID NO: 1659 |
| PPID | NM_005038.1 | Forward Primer<br>Probe<br>Reverse Primer | TCCTCATTTGGATGGGAAAC<br>TTCCTTTAATTACTTGGCCAAACACCACA<br>CCAATATCCTTGCCACTCCTA | SEQ ID NO: 1660<br>SEQ ID NO: 1661<br>SEQ ID NO: 1662 |
| PPM1D | NM_003620.1 | Forward Primer<br>Probe<br>Reverse Primer | GCCATCCGCAAAGGCTTT<br>TCGCTTGTCACCTTGCCATGTGG<br>GGCCATTCCGCCAGTTTC | SEQ ID NO: 1663<br>SEQ ID NO: 1664<br>SEQ ID NO: 1665 |
| PPP2R4 | NM_178001.1 | Forward Primer<br>Probe<br>Reverse Primer | GGCTCAGAGCATAAGGCTTC<br>TTGGTCACTTCTCCCAACTTGGGC<br>ACGGGAACTCAGAAAACTGG | SEQ ID NO: 1666<br>SEQ ID NO: 1667<br>SEQ ID NO: 1668 |
| PR | NM_000926.2 | Forward Primer<br>Probe<br>Reverse Primer | GCATCAGGCTGTCATTATGG<br>TGTCCTTACCTGTGGGAGCTGTAAGGTC<br>AGTAGTTGTGCTGCCCTTCC | SEQ ID NO: 1669<br>SEQ ID NO: 1670<br>SEQ ID NO: 1671 |
| PRDX2 | NM_005809.4 | Forward Primer<br>Probe<br>Reverse Primer | GGTGTCCTTCGCCAGATCAC<br>TTAATGATTTGCCTGTGGGACGCTCC<br>CAGCCGCAGAGCCTCATC | SEQ ID NO: 1672<br>SEQ ID NO: 1673<br>SEQ ID NO: 1674 |
| PRDX3 | NM_006793.2 | Forward Primer<br>Probe<br>Reverse Primer | TGACCCCAATGGAGTCATCA<br>CATTTGAGCGTCAACGATCTCCCAGTG<br>CCAAGCGGAGGGTTTCTTC | SEQ ID NO: 1675<br>SEQ ID NO: 1676<br>SEQ ID NO: 1677 |
| PRDX4 | NM_006406.1 | Forward Primer<br>Probe<br>Reverse Primer | TTACCCATTTGGCCTGGATTAA<br>CCAAGTCCTCCTTGTCTTCGAGGGGT<br>CTGAAAGAAGTGGAATCCTTATTGG | SEQ ID NO: 1678<br>SEQ ID NO: 1679<br>SEQ ID NO: 1680 |
| PRDX6 | NM_004905.2 | Forward Primer<br>Probe<br>Reverse Primer | CTGTGAGCCAGAGGATGTCA<br>CTGCCAATTGTGTTTTCCTGCAGC<br>TGTGATGACACCAGGATGTG | SEQ ID NO: 1681<br>SEQ ID NO: 1682<br>SEQ ID NO: 1683 |
| PRKCA | NM_002737.1 | Forward Primer<br>Probe<br>Reverse Primer | CAAGCAATGCGTCATCAATGT<br>CAGCCTCTGCGGAATGGATCACACT<br>GTAAATCCGCCCCCTCTTCT | SEQ ID NO: 1684<br>SEQ ID NO: 1685<br>SEQ ID NO: 1686 |
| PRKCB1 | NM_002738.5 | Forward Primer<br>Probe<br>Reverse Primer | GACCCAGCTCCACTCCTG<br>CCAGACCATGGACCGCCTGTACTT<br>CCCATTCACGTACTCCATCA | SEQ ID NO: 1687<br>SEQ ID NO: 1688<br>SEQ ID NO: 1689 |
| PRKCD | NM_006254.1 | Forward Primer<br>Probe<br>Reverse Primer | CTGACACTTGCCGCAGAGAA<br>CCCTTTCTCACCCACCTCATCTGCAC<br>AGGTGGTCCTTGGTCTGGAA | SEQ ID NO: 1690<br>SEQ ID NO: 1691<br>SEQ ID NO: 1692 |
| PRKR | NM_002759.1 | Forward Primer<br>Probe<br>Reverse Primer | GCGATACATGAGCCCAGAACA<br>AGGTCCACTTCCTTTCCATAGTCTTGCGA<br>TCAGCAAGAATTAGCCCCAAAG | SEQ ID NO: 1693<br>SEQ ID NO: 1694<br>SEQ ID NO: 1695 |
| pS2 | NM_003225.1 | Forward Primer<br>Probe<br>Reverse Primer | GCCCTCCCAGTGTGCAAAT<br>TGCTGTTTCGACGACAGGTTCG<br>CGTCGATGGTATTAGGATAGAAGCA | SEQ ID NO: 1696<br>SEQ ID NO: 1697<br>SEQ ID NO: 1698 |
| PTCH | NM_000264.2 | Forward Primer<br>Probe<br>Reverse Primer | CCACGACAAAGCCGACTAC<br>CCTGAAACAAGGCTGAGAATCCCG<br>TACTCGATGGGCTCTGCTG | SEQ ID NO: 1699<br>SEQ ID NO: 1700<br>SEQ ID NO: 1701 |
| PTEN | NM_000314.1 | Forward Primer<br>Probe<br>Reverse Primer | TGGCTAAGTGAAGATGACAATCATG<br>CCTTTCCAGCTTTACAGTGAATTGCTGCA<br>TGCACATATCATTACACCAGTTCGT | SEQ ID NO: 1702<br>SEQ ID NO: 1703<br>SEQ ID NO: 1704 |
| PTGER3 | NM_000957.2 | Forward Primer<br>Probe<br>Reverse Primer | TAACTGGGGCAACCTTTTCT<br>CCTTTGCCTTCCTGGGGCTCTT<br>TTGCAGGAAAAGGTGACTGT | SEQ ID NO: 1705<br>SEQ ID NO: 1706<br>SEQ ID NO: 1707 |

TABLE A-continued

| Gene | Accession | Reagent | Sequence | Sequence ID Number |
|---|---|---|---|---|
| PTHLH | NM_002820.1 | Forward Primer<br>Probe<br>Reverse Primer | AGTGACTGGGAGTGGGCTAGAA<br>TGACACCTCCACAACGTCGCTGGA<br>AAGCCTGTTACCGTGAATCGA | SEQ ID NO: 1708<br>SEQ ID NO: 1709<br>SEQ ID NO: 1710 |
| PTHR1 | NM_000316.1 | Forward Primer<br>Probe<br>Reverse Primer | CGAGGTACAAGCTGAGATCAAGAA<br>CCAGTGCCAGTGTCCAGCGGCT<br>GCGTGCCTTTCGCTTGAA | SEQ ID NO: 1711<br>SEQ ID NO: 1712<br>SEQ ID NO: 1713 |
| PTK2 | NM_005607.3 | Forward Primer<br>Probe<br>Reverse Primer | GACCGGTCGAATGATAAGGT<br>ACCAGGCCCGTCACATTCTCGTAC<br>CTGGACATCTCGATGACAGC | SEQ ID NO: 1714<br>SEQ ID NO: 1715<br>SEQ ID NO: 1716 |
| PTK2B | NM_004103.3 | Forward Primer<br>Probe<br>Reverse Primer | CAAGCCCAGCCGACCTAAG<br>CTCCGCAAACCAACCTCCTGGCT<br>GAACCTGGAACTGCAGCTTTG | SEQ ID NO: 1717<br>SEQ ID NO: 1718<br>SEQ ID NO: 1719 |
| PTP4A3 | NM_007079.2 | Forward Primer<br>Probe<br>Reverse Primer | CCTGTTCTCGGCACCTTAAA<br>ACCTGACTGCCCCGGGGTCTAATA<br>TATTGCCTTCGGGTGTCC | SEQ ID NO: 1720<br>SEQ ID NO: 1721<br>SEQ ID NO: 1722 |
| PTP4A3 v2 | NM_032611.1 | Forward Primer<br>Probe<br>Reverse Primer | AATATTTGTGCGGGGTATGG<br>CCAAGAGAAACGAGATTTAAAAACCCACC<br>AACGAGATCCCTGTGCTTGT | SEQ ID NO: 1723<br>SEQ ID NO: 1724<br>SEQ ID NO: 1725 |
| PTPD1 | NM_007039.2 | Forward Primer<br>Probe<br>Reverse Primer | CGCTTGCCTAACTCATACTTTCC<br>TCCACGCAGCGTGGCACTG<br>CCATTCAGACTGCGCCACTT | SEQ ID NO: 1726<br>SEQ ID NO: 1727<br>SEQ ID NO: 1728 |
| PTPN1 | NM_002827.2 | Forward Primer<br>Probe<br>Reverse Primer | AATGAGGAAGTTTCGGATGG<br>CTGATCCAGACAGCCGACCAGCT<br>CTTCGATCACAGCCAGGTAG | SEQ ID NO: 1729<br>SEQ ID NO: 1730<br>SEQ ID NO: 1731 |
| PTPRF | NM_002840.2 | Forward Primer<br>Probe<br>Reverse Primer | TGTTTTAGCTGAGGGACGTG<br>CCGACGTCCCCAAACCTAGCTAGG<br>TACCAACCCTGGAATGTTGA | SEQ ID NO: 1732<br>SEQ ID NO: 1733<br>SEQ ID NO: 1734 |
| PTPRJ | NM_002843.2 | Forward Primer<br>Probe<br>Reverse Primer | AACTTCCGGTACCTCGTTCGT<br>ACTACATGAAGCAGAGTCCTCCCGAATCG<br>AGCACTGCAATGCACCAGAA | SEQ ID NO: 1735<br>SEQ ID NO: 1736<br>SEQ ID NO: 1737 |
| PTPRO | NM_030667.1 | Forward Primer<br>Probe<br>Reverse Primer | CATGGCCTGATCATGGTGT<br>CCCACAGCAAATGCTGCAGAAAGT<br>CCATGTGTACAAACTGCAGGA | SEQ ID NO: 1738<br>SEQ ID NO: 1739<br>SEQ ID NO: 1740 |
| PTTG1 | NM_004219.2 | Forward Primer<br>Probe<br>Reverse Primer | GGCTACTCTGATCTATGTTGATAAGGAA<br>CACACGGGTGCCTGGTTCTCCA<br>GCTTCAGCCCATCCTTAGCA | SEQ ID NO: 1741<br>SEQ ID NO: 1742<br>SEQ ID NO: 1743 |
| RAB32 | NM_006834.2 | Forward Primer<br>Probe<br>Reverse Primer | CCTGCAGCTGTGGGACAT<br>CGATTTGGCAACATGACCCGAGTA<br>AGCACCAACAGCTTCCTTG | SEQ ID NO: 1744<br>SEQ ID NO: 1745<br>SEQ ID NO: 1746 |
| RAB6C | NM_032144.1 | Forward Primer<br>Probe<br>Reverse Primer | GCGACAGCTCCTCTAGTTCCA<br>TTCCCGAAGTCTCCGCCCG<br>GGAACACCAGCTTGAATTTCCT | SEQ ID NO: 1747<br>SEQ ID NO: 1748<br>SEQ ID NO: 1749 |
| RAC1 | NM_006908.3 | Forward Primer<br>Probe<br>Reverse Primer | TGTTGTAAATGTCTCAGCCCC<br>CGTTCTTGGTCCTGTCCCTTGGA<br>TTGAGCAAAGCGTACAAAGG | SEQ ID NO: 1750<br>SEQ ID NO: 1751<br>SEQ ID NO: 1752 |
| RAD51C | NM_058216.1 | Forward Primer<br>Probe<br>Reverse Primer | GAACTTCTTGAGCAGGAGCATACC<br>AGGGCTTCATAATCACCTTCTGTTC<br>TCCACCCCAAGAATATCATCTAGT | SEQ ID NO: 1753<br>SEQ ID NO: 1754<br>SEQ ID NO: 1755 |
| RAD54L | NM_003579.2 | Forward Primer<br>Probe<br>Reverse Primer | AGCTAGCCTCAGTGACACACATG<br>ACACAACGTCGGCAGTGCAACCTG<br>CCGGATCTGACGGCTGTT | SEQ ID NO: 1756<br>SEQ ID NO: 1757<br>SEQ ID NO: 1758 |
| RAF1 | NM_002880.1 | Forward Primer<br>Probe<br>Reverse Primer | CGTCGTATGCGAGAGTCTGT<br>TCCAGGATGCCTGTTAGTTCTCAGCA<br>TGAAGGCGTGAGGTGTAGAA | SEQ ID NO: 1759<br>SEQ ID NO: 1760<br>SEQ ID NO: 1761 |
| RALBP1 | NM_006788.2 | Forward Primer<br>Probe<br>Reverse Primer | GGTGTCAGATATAAATGTGCAAATGC<br>TGCTGTCCTGTCGGTCTCAGTACGTTCA<br>TTCGATATTGCCAGCAGCTATAAA | SEQ ID NO: 1762<br>SEQ ID NO: 1763<br>SEQ ID NO: 1764 |

TABLE A-continued

| Gene | Accession | Reagent | Sequence | Sequence ID Number |
|---|---|---|---|---|
| RANBP2 | NM_006267.3 | Forward Primer<br>Probe<br>Reverse Primer | TCCTTCAGCTTTCACACTGG<br>TCCAGAAGAGTCATGCAACTTCATTTCTG<br>AAATCCTGTTCCCACCTGAC | SEQ ID NO: 1765<br>SEQ ID NO: 1766<br>SEQ ID NO: 1767 |
| ranBP7 | NM_006391.1 | Forward Primer<br>Probe<br>Reverse Primer | AACATGATTATCCAAGCCGC<br>AAGCCAATTTTGTCCACAATGGCA<br>GCCAACAAGCACTGTTATCG | SEQ ID NO: 1768<br>SEQ ID NO: 1769<br>SEQ ID NO: 1770 |
| RANBP9 | NM_005493.2 | Forward Primer<br>Probe<br>Reverse Primer | CAAGTCAGTTGAGACGCCAGTT<br>TTCTATGGCGGCCTGACTTCCTCCA<br>TGCAGCTCTCGTCCAAAGTG | SEQ ID NO: 1771<br>SEQ ID NO: 1772<br>SEQ ID NO: 1773 |
| RAP1GDS1 | NM_021159.3 | Forward Primer<br>Probe<br>Reverse Primer | TGTGGATGCTGGATTGATTT<br>CCACTGGTGCAGCTGCTAAATAGCA<br>AAGCAGCACTTCCTGGTCTT | SEQ ID NO: 1774<br>SEQ ID NO: 1775<br>SEQ ID NO: 1776 |
| RARA | NM_000964.1 | Forward Primer<br>Probe<br>Reverse Primer | AGTCTGTGAGAAACGACCGAAAC<br>TCGGGCTTGGGCACCTCCTTCTT<br>CGGCGTCAGCGTGTAGCT | SEQ ID NO: 1777<br>SEQ ID NO: 1778<br>SEQ ID NO: 1779 |
| RARB | NM_016152.2 | Forward Primer<br>Probe<br>Reverse Primer | TGCCTGGACATCCTGATTCT<br>TGCACCAGGTATACCCCAGAACAAGA<br>AAGGCCGTCTGAGAAAGTCA | SEQ ID NO: 1780<br>SEQ ID NO: 1781<br>SEQ ID NO: 1782 |
| RASSF1 | NM_007182.3 | Forward Primer<br>Probe<br>Reverse Primer | AGTGGGAGACACCTGACCTT<br>TTGATCTTCTGCTCAATCTCAGCTTGAGA<br>TGATCTGGGCATTGTACTCC | SEQ ID NO: 1783<br>SEQ ID NO: 1784<br>SEQ ID NO: 1785 |
| RBM5 | NM_005778.1 | Forward Primer<br>Probe<br>Reverse Primer | CGAGAGGGAGAGCAAGACCAT<br>CTGCGCGGCCTTCCCATCA<br>TCTCGAATATCGCTCTCGTGATG | SEQ ID NO: 1786<br>SEQ ID NO: 1787<br>SEQ ID NO: 1788 |
| RBX1 | NM_014248.2 | Forward Primer<br>Probe<br>Reverse Primer | GGAACCACATTATGGATCTTTGC<br>TAGAATGTCAAGCTAACCAGGCGTCCGC<br>CATGCGACAGTACACTCTTCTGAA | SEQ ID NO: 1789<br>SEQ ID NO: 1790<br>SEQ ID NO: 1791 |
| RCC1 | NM_001269.2 | Forward Primer<br>Probe<br>Reverse Primer | GGGCTGGGTGAGAATGTG<br>ATACCAGGGCCGGCTTCTTCCTCT<br>CACAACATCCTCCGGAATG | SEQ ID NO: 1792<br>SEQ ID NO: 1793<br>SEQ ID NO: 1794 |
| REG4 | NM_032044.2 | Forward Primer<br>Probe<br>Reverse Primer | TGCTAACTCCTGCACAGCC<br>TCCTCTTCCTTTCTGCTAGCCTGGC<br>TGCTAGGTTTCCCCTCTGAA | SEQ ID NO: 1795<br>SEQ ID NO: 1796<br>SEQ ID NO: 1797 |
| RFC | NM_003056.1 | Forward Primer<br>Probe<br>Reverse Primer | TCAAGACCATCATCACTTTCATTGT<br>CCTCCCGGTCCGCAAGCAGTT<br>GGATCAGGAAGTACACGGAGTATAACT | SEQ ID NO: 1798<br>SEQ ID NO: 1799<br>SEQ ID NO: 1800 |
| RhoB | NM_004040.2 | Forward Primer<br>Probe<br>Reverse Primer | AAGCATGAACAGGACTTGACC<br>CTTTCCAACCCTGGGGAAGACAT<br>CCTCCCCAAGTCAGTTGC | SEQ ID NO: 1801<br>SEQ ID NO: 1802<br>SEQ ID NO: 1803 |
| rhoC | NM_175744.1 | Forward Primer<br>Probe<br>Reverse Primer | CCCGTTCGGTCTGAGGAA<br>TCCGGTTCGCCATGTCCCG<br>GAGCACTCAAGGTAGCCAAAGG | SEQ ID NO: 1804<br>SEQ ID NO: 1805<br>SEQ ID NO: 1806 |
| RIZ1 | NM_012231.1 | Forward Primer<br>Probe<br>Reverse Primer | CCAGACGAGCGATTAGAAGC<br>TGTGAGGTGAATGATTTGGGGGA<br>TCCTCCTCTTCCTCCTCCTC | SEQ ID NO: 1807<br>SEQ ID NO: 1808<br>SEQ ID NO: 1809 |
| RNF11 | NM_014372.3 | Forward Primer<br>Probe<br>Reverse Primer | ACCCTGGAAGAGATGGATCA<br>CCATCATACAGATCACACACTCCCGG<br>ATTGGGTCCCCATAAACAAA | SEQ ID NO: 1810<br>SEQ ID NO: 1811<br>SEQ ID NO: 1812 |
| ROCK1 | NM_005406.1 | Forward Primer<br>Probe<br>Reverse Primer | TGTGCACATAGGAATGAGCTTC<br>TCACTCTCTTTGCTGGCCAACTGC<br>GTTTAGCACGCAATTGCTCA | SEQ ID NO: 1813<br>SEQ ID NO: 1814<br>SEQ ID NO: 1815 |
| ROCK2 | NM_004850.3 | Forward Primer<br>Probe<br>Reverse Primer | GATCCGAGACCCTCGCTC<br>CCCATCAACGTGGAGAGCTTGCT<br>AGGACCAAGGAATTTAAGCCA | SEQ ID NO: 1816<br>SEQ ID NO: 1817<br>SEQ ID NO: 1818 |
| RPLPO | NM_001002.2 | Forward Primer<br>Probe<br>Reverse Primer | CCATTCTATCATCAACGGGTACAA<br>TCTCCACAGACAAGGCCAGGACTCG<br>TCAGCAAGTGGGAAGGTGTAATC | SEQ ID NO: 1819<br>SEQ ID NO: 1820<br>SEQ ID NO: 1821 |

TABLE A-continued

| Gene | Accession | Reagent | Sequence | Sequence ID Number |
|---|---|---|---|---|
| RPS13 | NM_001017.2 | Forward Primer | CAGTCGGCTTTACCCTATCG | SEQ ID NO: 1822 |
| | | Probe | CAACTTCAACCAAGTGGGGACGCT | SEQ ID NO: 1823 |
| | | Reverse Primer | TCTGCTCCTTCACGTCGTC | SEQ ID NO: 1824 |
| RRM1 | NM_001033.1 | Forward Primer | GGGCTACTGGCAGCTACATT | SEQ ID NO: 1825 |
| | | Probe | CATTGGAATTGCCATTAGTCCCAGC | SEQ ID NO: 1826 |
| | | Reverse Primer | CTCTCAGCATCGGTACAAGG | SEQ ID NO: 1827 |
| RRM2 | NM_001034.1 | Forward Primer | CAGCGGGATTAAACAGTCCT | SEQ ID NO: 1828 |
| | | Probe | CCAGCACAGCCAGTTAAAAGATGCA | SEQ ID NO: 1829 |
| | | Reverse Primer | ATCTGCGTTGAAGCAGTGAG | SEQ ID NO: 1830 |
| RTN4 | NM_007008.1 | Forward Primer | GACTGGAGTGGTGTTTGGTG | SEQ ID NO: 1831 |
| | | Probe | CCAGCCTATTCCTGCTGCTTTCATTG | SEQ ID NO: 1832 |
| | | Reverse Primer | CTGTTACGCTCACAATGCTG | SEQ ID NO: 1833 |
| RUNX1 | NM_001754.2 | Forward Primer | AACAGAGACATTGCCAACCA | SEQ ID NO: 1834 |
| | | Probe | TTGGATCTGCTTGCTGTCCAAACC | SEQ ID NO: 1835 |
| | | Reverse Primer | GTGATTTGCCCAGGAAGTTT | SEQ ID NO: 1836 |
| RXRA | NM_002957.3 | Forward Primer | GCTCTGTTGTGTCCTGTTGC | SEQ ID NO: 1837 |
| | | Probe | TCAGTCACAGGAAGGCCAGAGCC | SEQ ID NO: 1838 |
| | | Reverse Primer | GTACGGAGAAGCCACTTCACA | SEQ ID NO: 1839 |
| S100A1 | NM_006271.1 | Forward Primer | TGGACAAGGTGATGAAGGAG | SEQ ID NO: 1840 |
| | | Probe | CCTCCCCGTCTCCATTCTCGTCTA | SEQ ID NO: 1841 |
| | | Reverse Primer | AGCACCACATACTCCTGGAA | SEQ ID NO: 1842 |
| S100A2 | NM_005978.2 | Forward Primer | TGGCTGTGCTGGTCACTACCT | SEQ ID NO: 1843 |
| | | Probe | CACAAGTACTCCTGCCAAGAGGGCGAC | SEQ ID NO: 1844 |
| | | Reverse Primer | TCCCCCTTACTCAGCTTGAACT | SEQ ID NO: 1845 |
| S100A4 | NM_002961.2 | Forward Primer | GACTGCTGTCATGGCGTG | SEQ ID NO: 1846 |
| | | Probe | ATCACATCCAGGGCCTTCTCCAGA | SEQ ID NO: 1847 |
| | | Reverse Primer | CGAGTACTTGTGGAAGGTGGAC | SEQ ID NO: 1848 |
| S100A8 | NM_002964.3 | Forward Primer | ACTCCCTGATAAAGGGGAATTT | SEQ ID NO: 1849 |
| | | Probe | CATGCCGTCTACAGGGATGACCTG | SEQ ID NO: 1850 |
| | | Reverse Primer | TGAGGACACTCGGTCTCTAGC | SEQ ID NO: 1851 |
| S100A9 | NM_002965.2 | Forward Primer | CTTTGGGACAGAGTGCAAGA | SEQ ID NO: 1852 |
| | | Probe | CGATGACTTGCAAAATGTCGCAGC | SEQ ID NO: 1853 |
| | | Reverse Primer | TGGTCTCTATGTTGCGTTCC | SEQ ID NO: 1854 |
| S100P | NM_005980.2 | Forward Primer | AGACAAGGATGCCGTGGATAA | SEQ ID NO: 1855 |
| | | Probe | TTGCTCAAGGACCTGGACGCCAA | SEQ ID NO: 1856 |
| | | Reverse Primer | GAAGTCCACCTGGGCATCTC | SEQ ID NO: 1857 |
| SAT | NM_002970.1 | Forward Primer | CCTTTTACCACTGCCTGGTT | SEQ ID NO: 1858 |
| | | Probe | TCCAGTGCTCTTTCGGCACTTCTG | SEQ ID NO: 1859 |
| | | Reverse Primer | ACAATGCTGTGTCCTTCCG | SEQ ID NO: 1860 |
| SBA2 | NM_018639.3 | Forward Primer | GGACTCAACGATGGGCAG | SEQ ID NO: 1861 |
| | | Probe | CCCTGTCTGCACCTCCCAGATCTT | SEQ ID NO: 1862 |
| | | Reverse Primer | CGGAAAGATTCAAAAGCAGG | SEQ ID NO: 1863 |
| SDC1 | NM_002997.1 | Forward Primer | GAAATTGACGAGGGGTGTCT | SEQ ID NO: 1864 |
| | | Probe | CTCTGAGCGCCTCCATCCAAGG | SEQ ID NO: 1865 |
| | | Reverse Primer | AGGAGCTAACGGAGAACCTG | SEQ ID NO: 1866 |
| SEMA3B | NM_004636.1 | Forward Primer | GCTCCAGGATGTGTTTCTGTTG | SEQ ID NO: 1867 |
| | | Probe | TCGCGGGACCACCGGACC | SEQ ID NO: 1868 |
| | | Reverse Primer | ACGTGGAGAAGACGGCATAGA | SEQ ID NO: 1869 |
| SEMA3F | NM_004186.1 | Forward Primer | CGCGAGCCCCTCATTATACA | SEQ ID NO: 1870 |
| | | Probe | CTCCCCACAGCGCATCGAGGAA | SEQ ID NO: 1871 |
| | | Reverse Primer | CACTCGCCGTTGACATCCT | SEQ ID NO: 1872 |
| SEMA4B | NM_020210.1 | Forward Primer | TTCCAGCCCAACACAGTGAA | SEQ ID NO: 1873 |
| | | Probe | ACTTTGGCCTGCCCGCTCCTCT | SEQ ID NO: 1874 |
| | | Reverse Primer | GAGTCGGGTCGCCAGGTT | SEQ ID NO: 1875 |
| SFRP2 | NM_003013.2 | Forward Primer | CAAGCTGAACGGTGTGTCC | SEQ ID NO: 1876 |
| | | Probe | CAGCACCGATTTCTTCAGGTCCCT | SEQ ID NO: 1877 |
| | | Reverse Primer | TGCAAGCTGTCTTTGAGCC | SEQ ID NO: 1878 |

TABLE A-continued

| Gene | Accession | Reagent | Sequence | Sequence ID Number |
|---|---|---|---|---|
| SFRP4 | NM_003014.2 | Forward Primer<br>Probe<br>Reverse Primer | TACAGGATGAGGCTGGGC<br>CCTGGGACAGCCTATGTAAGGCCA<br>GTTGTTAGGGCAAGGGGC | SEQ ID NO: 1879<br>SEQ ID NO: 1880<br>SEQ ID NO: 1881 |
| SGCB | NM_000232.1 | Forward Primer<br>Probe<br>Reverse Primer | CAGTGGAGACCAGTTGGGTAGTG<br>CACACATGCAGAGCTTGTAGCGTACCCA<br>CCTTGAAGAGCGTCCCATCA | SEQ ID NO: 1882<br>SEQ ID NO: 1883<br>SEQ ID NO: 1884 |
| SHC1 | NM_003029.3 | Forward Primer<br>Probe<br>Reverse Primer | CCAACACCTTCTTGGCTTCT<br>CCTGTGTTCTTGCTGAGCACCCTC<br>CTGTTATCCCAACCCAAACC | SEQ ID NO: 1885<br>SEQ ID NO: 1886<br>SEQ ID NO: 1887 |
| SHH | NM_000193.2 | Forward Primer<br>Probe<br>Reverse Primer | GTCCAAGGCACATATCCACTG<br>CACCGAGTTCTCTGCTTTCACCGA<br>GAAGCAGCCTCCCGATTT | SEQ ID NO: 1888<br>SEQ ID NO: 1889<br>SEQ ID NO: 1890 |
| SI | NM_001041.1 | Forward Primer<br>Probe<br>Reverse Primer | AACGGACTCCCTCAATTTGT<br>TGTCCATGGTCATGCAAATCTTGC<br>GAAATTGCAGGGTCCAAGAT | SEQ ID NO: 1891<br>SEQ ID NO: 1892<br>SEQ ID NO: 1893 |
| Siah-1 | NM_003031.2 | Forward Primer<br>Probe<br>Reverse Primer | TTGGCATTGGAACTACATTCA<br>TCCGCGGTATCCTCGGATTAGTTC<br>GGTATGGAGAAGGGGGTCC | SEQ ID NO: 1894<br>SEQ ID NO: 1895<br>SEQ ID NO: 1896 |
| SIAT4A | NM_003033.2 | Forward Primer<br>Probe<br>Reverse Primer | AACCACAGTTGGAGGAGGAC<br>CAGAGACAGTTTCCCTCCCCGCT<br>CGAAGGAAGGGTGTTGGTAT | SEQ ID NO: 1897<br>SEQ ID NO: 1898<br>SEQ ID NO: 1899 |
| SIAT7B | NM_006456.1 | Forward Primer<br>Probe<br>Reverse Primer | TCCAGCCCAAATCCTCCT<br>TGGCACATCCTACCCCAGATGCTA<br>GGTGTCCTGGAGTCCTTGAA | SEQ ID NO: 1900<br>SEQ ID NO: 1901<br>SEQ ID NO: 1902 |
| SIM2 | NM_005069.2 | Forward Primer<br>Probe<br>Reverse Primer | GATGGTAGGAAGGGATGTGC<br>CGCCTCTCCACGCACTCAGCTAT<br>CACAAGGAGCTGTGAATGAGG | SEQ ID NO: 1903<br>SEQ ID NO: 1904<br>SEQ ID NO: 1905 |
| SIN3A | NM_015477.1 | Forward Primer<br>Probe<br>Reverse Primer | CCAGAGTCATGCTCATCCAG<br>CTGTCCCTGCACTGGTGCAACTG<br>CCACCTTCAGCCTCTGAAAT | SEQ ID NO: 1906<br>SEQ ID NO: 1907<br>SEQ ID NO: 1908 |
| SIR2 | NM_012238.3 | Forward Primer<br>Probe<br>Reverse Primer | AGCTGGGGTGTCTGTTTCAT<br>CCTGACTTCAGGTCAAGGGATGG<br>ACAGCAAGGCGAGCATAAAT | SEQ ID NO: 1909<br>SEQ ID NO: 1910<br>SEQ ID NO: 1911 |
| SKP1A | NM_006930.2 | Forward Primer<br>Probe<br>Reverse Primer | CCATTGCCTTTGCTTTGTTCAT<br>TCCCATGGTTTTTATTCTGCCCTGCTG<br>TTCCGGATTTCCTTTCTTTGC | SEQ ID NO: 1912<br>SEQ ID NO: 1913<br>SEQ ID NO: 1914 |
| SKP2 | NM_005983.2 | Forward Primer<br>Probe<br>Reverse Primer | AGTTGCAGAATCTAAGCCTGGAA<br>CCTGCGGCTTTCGGATCCCA<br>TGAGTTTTTTGCGAGAGTATTGACA | SEQ ID NO: 1915<br>SEQ ID NO: 1916<br>SEQ ID NO: 1917 |
| SLC25A3 | NM_213611.1 | Forward Primer<br>Probe<br>Reverse Primer | TCTGCCAGTGCTGAATTCTT<br>TGCTGACATTGCCCTGGCTCCTAT<br>TTCGAACCTTAGCAGCTTCC | SEQ ID NO: 1918<br>SEQ ID NO: 1919<br>SEQ ID NO: 1920 |
| SLC2A1 | NM_006516.1 | Forward Primer<br>Probe<br>Reverse Primer | GCCTGAGTCTCCTGTGCC<br>ACATCCCAGGCTTCACCCTGAATG<br>AGTCTCCACCCTCAGGCAT | SEQ ID NO: 1921<br>SEQ ID NO: 1922<br>SEQ ID NO: 1923 |
| SLC31A1 | NM_001859.2 | Forward Primer<br>Probe<br>Reverse Primer | CCGTTCGAAGAGTCGTGAG<br>TCTCCGAATCTTAACCCGTCACCC<br>AGTCCAGCCACTAGCACCTC | SEQ ID NO: 1924<br>SEQ ID NO: 1925<br>SEQ ID NO: 1926 |
| SLC5A8 | NM_145913.2 | Forward Primer<br>Probe<br>Reverse Primer | CCTGCTTTCAACCACATTGA<br>TCCCATTGCTCTTGCCACTCTGAT<br>AGAGCAGCTTCACAAACGAG | SEQ ID NO: 1927<br>SEQ ID NO: 1928<br>SEQ ID NO: 1929 |
| SLC7A5 | NM_003486.4 | Forward Primer<br>Probe<br>Reverse Primer | GCGCAGAGGCCAGTTAAA<br>AGATCACCTCCTCGAACCCACTCC<br>AGCTGAGCTGTGGGTTGC | SEQ ID NO: 1930<br>SEQ ID NO: 1931<br>SEQ ID NO: 1932 |
| SLPI | NM_003064.2 | Forward Primer<br>Probe<br>Reverse Primer | ATGGCCAATGTTTGATGCT<br>TGGCCATCCATCTCACAGAAATTGG<br>ACACTTCAAGTCACGCTTGC | SEQ ID NO: 1933<br>SEQ ID NO: 1934<br>SEQ ID NO: 1935 |

TABLE A-continued

| Gene | Accession | Reagent | Sequence | Sequence ID Number |
|---|---|---|---|---|
| SMARCA3 | NM_003071.2 | Forward Primer | AGGGACTGTCCTGGCACAT | SEQ ID NO: 1936 |
| | | Probe | AGCAAAAGACCCAGGACATCTGCA | SEQ ID NO: 1937 |
| | | Reverse Primer | CAACAAATTTGCCGCAGTC | SEQ ID NO: 1938 |
| SNAI1 | NM_005985.2 | Forward Primer | CCCAATCGGAAGCCTAACTA | SEQ ID NO: 1939 |
| | | Probe | TCTGGATTAGAGTCCTGCAGCTCGC | SEQ ID NO: 1940 |
| | | Reverse Primer | GTAGGGCTGCTGGAAGGTAA | SEQ ID NO: 1941 |
| SNAI2 | NM_003068.3 | Forward Primer | GGCTGGCCAAACATAAGCA | SEQ ID NO: 1942 |
| | | Probe | CTGCACTGCGATGCCCAGTCTAGAAAATC | SEQ ID NO: 1943 |
| | | Reverse Primer | TCCTTGTCACAGTATTTACAGCTGAA | SEQ ID NO: 1944 |
| SNRPF | NM_003095.1 | Forward Primer | GGCTGGTCGGCAGAGAGTAG | SEQ ID NO: 1945 |
| | | Probe | AAACTCATGTAAACCACGGCCGAATGTTG | SEQ ID NO: 1946 |
| | | Reverse Primer | TGAGGAAAGGTTTGGGATTGA | SEQ ID NO: 1947 |
| SOD1 | NM_000454.3 | Forward Primer | TGAAGAGAGGCATGTTGGAG | SEQ ID NO: 1948 |
| | | Probe | TTTGTCAGCAGTCACATTGCCCAA | SEQ ID NO: 1949 |
| | | Reverse Primer | AATAGACACATCGGCCACAC | SEQ ID NO: 1950 |
| SOD2 | NM_000636.1 | Forward Primer | GCTTGTCCAAATCAGGATCCA | SEQ ID NO: 1951 |
| | | Probe | AACAACAGGCCTTATTCCACTGCTGGG | SEQ ID NO: 1952 |
| | | Reverse Primer | AGCGTGCTCCCACACATCA | SEQ ID NO: 1953 |
| SOS1 | NM_005633.2 | Forward Primer | TCTGCACCAAATTCTCCAAG | SEQ ID NO: 1954 |
| | | Probe | AACACCGTTAACACCTCCGCCTG | SEQ ID NO: 1955 |
| | | Reverse Primer | GTGGTACTGGAAGCACCAGA | SEQ ID NO: 1956 |
| SOX17 | NM_022454.2 | Forward Primer | TCGTGTGCAAGCCTGAGA | SEQ ID NO: 1957 |
| | | Probe | CTCCCCTACCAGGGGCATGACTC | SEQ ID NO: 1958 |
| | | Reverse Primer | CTGTCGGGGAGATTCACAC | SEQ ID NO: 1959 |
| SPARC | NM_003118.1 | Forward Primer | TCTTCCCTGTACACTGGCAGTTC | SEQ ID NO: 1960 |
| | | Probe | TGGACCAGCACCCCATTGACGG | SEQ ID NO: 1961 |
| | | Reverse Primer | AGCTCGGTGTGGGAGAGGTA | SEQ ID NO: 1962 |
| SPINT2 | NM_021102.1 | Forward Primer | AGGAATGCAGCGGATTCCT | SEQ ID NO: 1963 |
| | | Probe | CCCAAGTGCTCCCAGAAGGCAGG | SEQ ID NO: 1964 |
| | | Reverse Primer | TCGCTGGAGTGGTCTTCAGA | SEQ ID NO: 1965 |
| SPRY1 | AK026960.1 | Forward Primer | CAGACCAGTCCCTGGTCATAGG | SEQ ID NO: 1966 |
| | | Probe | CTGGGTCCGGATTGCCCTTTCAG | SEQ ID NO: 1967 |
| | | Reverse Primer | CCTTCAAGTCATCCACAATCAGTT | SEQ ID NO: 1968 |
| SPRY2 | NM_005842.1 | Forward Primer | TGTGGCAAGTGCAAATGTAA | SEQ ID NO: 1969 |
| | | Probe | CAGAGGCCTTGGGTAGGTGCACTC | SEQ ID NO: 1970 |
| | | Reverse Primer | GTCGCAGATCCAGTCTGATG | SEQ ID NO: 1971 |
| SR-A1 | NM_021228.1 | Forward Primer | AGATGGAAGAAGCCAACCTG | SEQ ID NO: 1972 |
| | | Probe | CTGGATCAGCTCCTGGGCCTTC | SEQ ID NO: 1973 |
| | | Reverse Primer | CTGTGGCTGAGGATCTGGT | SEQ ID NO: 1974 |
| ST14 | NM_021978.2 | Forward Primer | TGACTGCACATGGAACATTG | SEQ ID NO: 1975 |
| | | Probe | AGGTGCCCAACAACCAGCATGT | SEQ ID NO: 1976 |
| | | Reverse Primer | AAGAATTTGAAGCGCACCTT | SEQ ID NO: 1977 |
| STAT1 | NM_007315.1 | Forward Primer | GGGCTCAGCTTTCAGAAGTG | SEQ ID NO: 1978 |
| | | Probe | TGGCAGTTTTCTTCTGTCACCAAAA | SEQ ID NO: 1979 |
| | | Reverse Primer | ACATGTTCAGCTGGTCCACA | SEQ ID NO: 1980 |
| STAT3 | NM_003150.1 | Forward Primer | TCACATGCCACTTTGGTGTT | SEQ ID NO: 1981 |
| | | Probe | TCCTGGGAGAGATTGACCAGCA | SEQ ID NO: 1982 |
| | | Reverse Primer | CTTGCAGGAAGCGGCTATAC | SEQ ID NO: 1983 |
| STAT5A | NM_003152.1 | Forward Primer | GAGGCGCTCAACATGAAATTC | SEQ ID NO: 1984 |
| | | Probe | CGGTTGCTCTGCACTTCGGCCT | SEQ ID NO: 1985 |
| | | Reverse Primer | GCCAGGAACACGAGGTTCTC | SEQ ID NO: 1986 |
| STAT5B | NM_012448.1 | Forward Primer | CCAGTGGTGGTGATCGTTCA | SEQ ID NO: 1987 |
| | | Probe | CAGCCAGGACAACAATGCGACGG | SEQ ID NO: 1988 |
| | | Reverse Primer | GCAAAAGCATTGTCCCAGAGA | SEQ ID NO: 1989 |
| STC1 | NM_003155.1 | Forward Primer | CTCCGAGGTGAGGAGGACT | SEQ ID NO: 1990 |
| | | Probe | CACATCAAACGCACATCCCATGAG | SEQ ID NO: 1991 |
| | | Reverse Primer | ACCTCTCCCTGGTTATGCAC | SEQ ID NO: 1992 |

TABLE A-continued

| Gene | Accession | Reagent | Sequence | Sequence ID Number |
|---|---|---|---|---|
| STK11 | NM_000455.3 | Forward Primer | GGACTCGGAGACGCTGTG | SEQ ID NO: 1993 |
| | | Probe | TTCTTGAGGATCTTGACGGCCCTC | SEQ ID NO: 1994 |
| | | Reverse Primer | GGGATCCTTCGCAACTTCTT | SEQ ID NO: 1995 |
| STK15 | NM_003600.1 | Forward Primer | CATCTTCCAGGAGGACCACT | SEQ ID NO: 1996 |
| | | Probe | CTCTGTGGCACCCTGGACTACCTG | SEQ ID NO: 1997 |
| | | Reverse Primer | TCCGACCTTCAATCATTTCA | SEQ ID NO: 1998 |
| STMN1 | NM_005563.2 | Forward Primer | AATACCCAACGCACAAATGA | SEQ ID NO: 1999 |
| | | Probe | CACGTTCTCTGCCCCGTTTCTTG | SEQ ID NO: 2000 |
| | | Reverse Primer | GGAGACAATGCAAACCACAC | SEQ ID NO: 2001 |
| STMY3 | NM_005940.2 | Forward Primer | CCTGGAGGCTGCAACATACC | SEQ ID NO: 2002 |
| | | Probe | ATCCTCCTGAAGCCCTTTTCGCAGC | SEQ ID NO: 2003 |
| | | Reverse Primer | TACAATGGCTTTGGAGGATAGCA | SEQ ID NO: 2004 |
| STS | NM_000351.2 | Forward Primer | GAAGATCCCTTTCCTCCTACTGTTC | SEQ ID NO: 2005 |
| | | Probe | CTTCGTGGCTCTCGGCTTCCCA | SEQ ID NO: 2006 |
| | | Reverse Primer | GGATGATGTTCGGCCTTGAT | SEQ ID NO: 2007 |
| SURV | NM_001168.1 | Forward Primer | TGTTTTGATTCCCGGGCTTA | SEQ ID NO: 2008 |
| | | Probe | TGCCTTCTTCCTCCCTCACTTCTCACCT | SEQ ID NO: 2009 |
| | | Reverse Primer | CAAAGCTGTCAGCTCTAGCAAAAG | SEQ ID NO: 2010 |
| TAGLN | NM_003186.2 | Forward Primer | GATGGAGCAGGTGGCTCAGT | SEQ ID NO: 2011 |
| | | Probe | CCCAGAGTCCTCAGCCGCCTTCAG | SEQ ID NO: 2012 |
| | | Reverse Primer | AGTCTGGAACATGTCAGTCTTGATG | SEQ ID NO: 2013 |
| TBP | NM_003194.1 | Forward Primer | GCCCGAAACGCCGAATATA | SEQ ID NO: 2014 |
| | | Probe | TACCGCAGCAAACCGCTTGGG | SEQ ID NO: 2015 |
| | | Reverse Primer | CGTGGCTCTCTTATCCTCATGAT | SEQ ID NO: 2016 |
| TCF-1 | NM_000545.3 | Forward Primer | GAGGTCCTGAGCACTGCC | SEQ ID NO: 2017 |
| | | Probe | CTGGGTTCACAGGCTCCTTTGTCC | SEQ ID NO: 2018 |
| | | Reverse Primer | GATGTGGGACCATGCTTGT | SEQ ID NO: 2019 |
| TCF-7 | NM_003202.2 | Forward Primer | GCAGCTGCAGTCAACAGTTC | SEQ ID NO: 2020 |
| | | Probe | AAGTCATGGCCCAAATCCAGTGTG | SEQ ID NO: 2021 |
| | | Reverse Primer | CTGTGAATGGGGAGGGGT | SEQ ID NO: 2022 |
| TCF7L1 | NM_031283.1 | Forward Primer | CCGGGACACTTTCCAGAAG | SEQ ID NO: 2023 |
| | | Probe | TCTCACTTCGGCGAAATAGTCCCG | SEQ ID NO: 2024 |
| | | Reverse Primer | AGAACGCGCTGTCCTGAG | SEQ ID NO: 2025 |
| TCF7L2 | NM_030756.1 | Forward Primer | CCAATCACGACAGGAGGATT | SEQ ID NO: 2026 |
| | | Probe | AGACACCCCTACCCCACAGCTCTG | SEQ ID NO: 2027 |
| | | Reverse Primer | TGGACACGGAAGCATTGAC | SEQ ID NO: 2028 |
| TCFL4 | NM_170607.2 | Forward Primer | CTGACTGCTCTGCTTAAAGGTGAA | SEQ ID NO: 2029 |
| | | Probe | TAGCAGGAACAACAACAAAAGCCAACCAA | SEQ ID NO: 2030 |
| | | Reverse Primer | ATGTCTTGCACTGGCTACCTTGT | SEQ ID NO: 2031 |
| TEK | NM_000459.1 | Forward Primer | ACTTCGGTGCTACTTAACAACTTACATC | SEQ ID NO: 2032 |
| | | Probe | AGCTCGGACCACGTACTGCTCCCTG | SEQ ID NO: 2033 |
| | | Reverse Primer | CCTGGGCCTTGGTGTTGAC | SEQ ID NO: 2034 |
| TERC | U86046.1 | Forward Primer | AAGAGGAACGGAGCGAGTC | SEQ ID NO: 2035 |
| | | Probe | CACGTCCCACAGCTCAGGGAATC | SEQ ID NO: 2036 |
| | | Reverse Primer | ATGTGTGAGCCGAGTCCTG | SEQ ID NO: 2037 |
| TERT | NM_003219.1 | Forward Primer | GACATGGAGAACAAGCTGTTTGC | SEQ ID NO: 2038 |
| | | Probe | ACCAAACGCAGGAGCAGCCCG | SEQ ID NO: 2039 |
| | | Reverse Primer | GAGGTGTCACCAACAAGAAATCAT | SEQ ID NO: 2040 |
| TFF3 | NM_003226.1 | Forward Primer | AGGCACTGTTCATCTCAGTTTTCT | SEQ ID NO: 2041 |
| | | Probe | CAGAAAGCTTGCCGGGAGCAAAGG | SEQ ID NO: 2042 |
| | | Reverse Primer | CATCAGGCTCCAGATATGAACTTTC | SEQ ID NO: 2043 |
| TGFA | NM_003236.1 | Forward Primer | GGTGTGCCACAGACCTTCCT | SEQ ID NO: 2044 |
| | | Probe | TTGGCCTGTAATCACCTGTGCAGCCTT | SEQ ID NO: 2045 |
| | | Reverse Primer | ACGGAGTTCTTGACAGAGTTTTGA | SEQ ID NO: 2046 |
| TGFB2 | NM_003238.1 | Forward Primer | ACCAGTCCCCCAGAAGACTA | SEQ ID NO: 2047 |
| | | Probe | TCCTGAGCCCGAGGAAGTCCC | SEQ ID NO: 2048 |
| | | Reverse Primer | CCTGGTGCTGTTGTAGATGG | SEQ ID NO: 2049 |

TABLE A-continued

| Gene | Accession | Reagent | Sequence | Sequence ID Number |
|---|---|---|---|---|
| TGFB3 | NM_003239.1 | Forward Primer<br>Probe<br>Reverse Primer | GGATCGAGCTCTTCCAGATCCT<br>CGGCCAGATGAGCACATTGCC<br>GCCACCGATATAGCGCTGTT | SEQ ID NO: 2050<br>SEQ ID NO: 2051<br>SEQ ID NO: 2052 |
| TGFBI | NM_000358.1 | Forward Primer<br>Probe<br>Reverse Primer | GCTACGAGTGCTGTCCTGG<br>CCTTCTCCCCAGGGACCTTTTCAT<br>AGTGGTAGGGCTGCTGGAC | SEQ ID NO: 2053<br>SEQ ID NO: 2054<br>SEQ ID NO: 2055 |
| TGFBR1 | NM_004612.1 | Forward Primer<br>Probe<br>Reverse Primer | GTCATCACCTGGCCTTGG<br>AGCAATGACAGCTGCCAGTTCCAC<br>GCAGACGAAGCACACTGGT | SEQ ID NO: 2056<br>SEQ ID NO: 2057<br>SEQ ID NO: 2058 |
| TGFBR2 | NM_003242.2 | Forward Primer<br>Probe<br>Reverse Primer | AACACCAATGGGTTCCATCT<br>TTCTGGGCTCCTGATTGCTCAAGC<br>CCTCTTCATCAGGCCAAACT | SEQ ID NO: 2059<br>SEQ ID NO: 2060<br>SEQ ID NO: 2061 |
| THBS1 | NM_003246.1 | Forward Primer<br>Probe<br>Reverse Primer | CATCCGCAAAGTGACTGAAGAG<br>CCAATGAGCTGAGGCGGCCTCC<br>GTACTGAACTCCGTTGTGATAGCATAG | SEQ ID NO: 2062<br>SEQ ID NO: 2063<br>SEQ ID NO: 2064 |
| THY1 | NM_006288.2 | Forward Primer<br>Probe<br>Reverse Primer | GGACAAGACCCTCTCAGGCT<br>CAAGCTCCCAAGAGCTTCCAGAGC<br>TTGGAGGCTGTGGGTCAG | SEQ ID NO: 2065<br>SEQ ID NO: 2066<br>SEQ ID NO: 2067 |
| TIMP1 | NM_003254.1 | Forward Primer<br>Probe<br>Reverse Primer | TCCCTGCGGTCCCAGATAG<br>ATCCTGCCCGGAGTGGAACTGAAGC<br>GTGGGAACAGGGTGGACACT | SEQ ID NO: 2068<br>SEQ ID NO: 2069<br>SEQ ID NO: 2070 |
| TIMP2 | NM_003255.2 | Forward Primer<br>Probe<br>Reverse Primer | TCACCCTCTGTGACTTCATCGT<br>CCCTGGGACACCCTGAGCACCA<br>TGTGGTTCAGGCTCTTCTTCTG | SEQ ID NO: 2071<br>SEQ ID NO: 2072<br>SEQ ID NO: 2073 |
| TIMP3 | NM_000362.2 | Forward Primer<br>Probe<br>Reverse Primer | CTACCTGCCTTGCTTTGTGA<br>CCAAGAACGAGTGTCTCTGGACCG<br>ACCGAAATTGGAGAGCATGT | SEQ ID NO: 2074<br>SEQ ID NO: 2075<br>SEQ ID NO: 2076 |
| TJP1 | NM_003257.1 | Forward Primer<br>Probe<br>Reverse Primer | ACTTTGCTGGGACAAAGGTC<br>CTCGGGCCTGCCCACTTCTTC<br>CACATGGACTCCTCAGCATC | SEQ ID NO: 2077<br>SEQ ID NO: 2078<br>SEQ ID NO: 2079 |
| TK1 | NM_003258.1 | Forward Primer<br>Probe<br>Reverse Primer | GCCGGGAAGACCGTAATTGT<br>CAAATGGCTTCCTCTGGAAGGTCCCA<br>CAGCGGCACCAGGTTCAG | SEQ ID NO: 2080<br>SEQ ID NO: 2081<br>SEQ ID NO: 2082 |
| TLN1 | NM_006289.2 | Forward Primer<br>Probe<br>Reverse Primer | AAGCAGAAGGGAGAGCGTAAGA<br>CTTCCAGGCACACAAGAATTGTGGGC<br>CCTTGGCCTCAATCTCACTCA | SEQ ID NO: 2083<br>SEQ ID NO: 2084<br>SEQ ID NO: 2085 |
| TMEPAI | NM_020182.3 | Forward Primer<br>Probe<br>Reverse Primer | CAGAAGGATGCCTGTGGC<br>ATTCCGTTGCCTGACACTGTGCTC<br>GTAGACCTGCGGCTCTGG | SEQ ID NO: 2086<br>SEQ ID NO: 2087<br>SEQ ID NO: 2088 |
| TMSB10 | NM_021103.2 | Forward Primer<br>Probe<br>Reverse Primer | GAAATCGCCAGCTTCGATAA<br>CGTCTCCGTTTTCTTCAGCTTGGC<br>GTCGGCAGGGTGTTCTTTT | SEQ ID NO: 2089<br>SEQ ID NO: 2090<br>SEQ ID NO: 2091 |
| TMSB4X | NM_021109.2 | Forward Primer<br>Probe<br>Reverse Primer | CACATCAAAGAACTACTGACAACGAA<br>CCGCGCCTGCCTTTCCCA<br>CCTGCCAGCCAGATAGATAGACA | SEQ ID NO: 2092<br>SEQ ID NO: 2093<br>SEQ ID NO: 2094 |
| TNC | NM_002160.1 | Forward Primer<br>Probe<br>Reverse Primer | AGCTCGGAACCTCACCGT<br>CAGCCTTCGGGCTGTGGACATAC<br>GTAGCAGCCTTGAGGCCC | SEQ ID NO: 2095<br>SEQ ID NO: 2096<br>SEQ ID NO: 2097 |
| TNF | NM_000594.1 | Forward Primer<br>Probe<br>Reverse Primer | GGAGAAGGGTGACCGACTCA<br>CGCTGAGATCAATCGGCCCGACTA<br>TGCCCAGACTCGGCAAAG | SEQ ID NO: 2098<br>SEQ ID NO: 2099<br>SEQ ID NO: 2100 |
| TNFRSF5 | NM_001250.3 | Forward Primer<br>Probe<br>Reverse Primer | TCTCACCTCGCTATGGTTCGT<br>TGCCTCTGCAGTGCGTCCTCTGG<br>GATGGACAGCGGTCAGCAA | SEQ ID NO: 2101<br>SEQ ID NO: 2102<br>SEQ ID NO: 2103 |
| TNFRSF6B | NM_003823.2 | Forward Primer<br>Probe<br>Reverse Primer | CCTCAGCACCAGGGTACCA<br>TGACGGCACGCTCACACTCCTCAG<br>TGTCCTGGAAAGCCACAAAGT | SEQ ID NO: 2104<br>SEQ ID NO: 2105<br>SEQ ID NO: 2106 |

TABLE A-continued

| Gene | Accession | Reagent | Sequence | Sequence ID Number |
|---|---|---|---|---|
| TNFSF4 | NM_003326.2 | Forward Primer | CTTCATCTTCCCTCTACCCAGA | SEQ ID NO: 2107 |
| | | Probe | CAGGGGTTGGACCCTTTCCATCTT | SEQ ID NO: 2108 |
| | | Reverse Primer | GCTGCATTTCCCACATTCTC | SEQ ID NO: 2109 |
| TOP2A | NM_001067.1 | Forward Primer | AATCCAAGGGGGAGAGTGAT | SEQ ID NO: 2110 |
| | | Probe | CATATGGACTTTGACTCAGCTGTGGC | SEQ ID NO: 2111 |
| | | Reverse Primer | GTACAGATTTTGCCCGAGGA | SEQ ID NO: 2112 |
| TOP2B | NM_001068.1 | Forward Primer | TGTGGACATCTTCCCCTCAGA | SEQ ID NO: 2113 |
| | | Probe | TTCCCTACTGAGCCACCTTCTCTG | SEQ ID NO: 2114 |
| | | Reverse Primer | CTAGCCCGACCGGTTCGT | SEQ ID NO: 2115 |
| TP | NM_001953.2 | Forward Primer | CTATATGCAGCCAGAGATGTGACA | SEQ ID NO: 2116 |
| | | Probe | ACAGCCTGCCACTCATCACAGCC | SEQ ID NO: 2117 |
| | | Reverse Primer | CCACGAGTTTCTTACTGAGAATGG | SEQ ID NO: 2118 |
| TP53BP1 | NM_005657.1 | Forward Primer | TGCTGTTGCTGAGTCTGTTG | SEQ ID NO: 2119 |
| | | Probe | CCAGTCCCCAGAAGACCATGTCTG | SEQ ID NO: 2120 |
| | | Reverse Primer | CTTGCCTGGCTTCACAGATA | SEQ ID NO: 2121 |
| TP53BP2 | NM_005426.1 | Forward Primer | GGGCCAAATATTCAGAAGC | SEQ ID NO: 2122 |
| | | Probe | CCACCATAGCGGCCATGGAG | SEQ ID NO: 2123 |
| | | Reverse Primer | GGATGGGTATGATGGGACAG | SEQ ID NO: 2124 |
| TP53I3 | NM_004881.2 | Forward Primer | GCGGACTTAATGCAGAGACA | SEQ ID NO: 2125 |
| | | Probe | CAGTATGACCCACCTCCAGGAGCC | SEQ ID NO: 2126 |
| | | Reverse Primer | TCAAGTCCCAAAATGTTGCT | SEQ ID NO: 2127 |
| TRAG3 | NM_004909.1 | Forward Primer | GACGCTGGTCTGGTGAAGATG | SEQ ID NO: 2128 |
| | | Probe | CCAGGAAACCACGAGCCTCCAGC | SEQ ID NO: 2129 |
| | | Reverse Primer | TGGGTGGTTGTTGGACAATG | SEQ ID NO: 2130 |
| TRAIL | NM_003810.1 | Forward Primer | CTTCACAGTGCTCCTGCAGTCT | SEQ ID NO: 2131 |
| | | Probe | AAGTACACGTAAGTTACAGCCACACA | SEQ ID NO: 2132 |
| | | Reverse Primer | CATCTGCTTCAGCTCGTTGGT | SEQ ID NO: 2133 |
| TS | NM_001071.1 | Forward Primer | GCCTCGGTGTGCCTTTCA | SEQ ID NO: 2134 |
| | | Probe | CATCGCCAGCTACGCCCTGCTC | SEQ ID NO: 2135 |
| | | Reverse Primer | CGTGATGTGCGCAATCATG | SEQ ID NO: 2136 |
| TST | NM_003312.4 | Forward Primer | GGAGCCGGATGCAGTAGGA | SEQ ID NO: 2137 |
| | | Probe | ACCACGGATATGGCCCGAGTCCA | SEQ ID NO: 2138 |
| | | Reverse Primer | AAGTCCATGAAAGGCATGTTGA | SEQ ID NO: 2139 |
| TUBA1 | NM_006000.1 | Forward Primer | TGTCACCCCGACTCAACGT | SEQ ID NO: 2140 |
| | | Probe | AGACGCACCGCCCGGACTCAC | SEQ ID NO: 2141 |
| | | Reverse Primer | ACGTGGACTGAGATGCATTCAC | SEQ ID NO: 2142 |
| TUBB | NM_001069.1 | Forward Primer | CGAGGACGAGGCTTAAAAAC | SEQ ID NO: 2143 |
| | | Probe | TCTCAGATCAATCGTGCATCCTTAGTGAA | SEQ ID NO: 2144 |
| | | Reverse Primer | ACCATGCTTGAGGACAACAG | SEQ ID NO: 2145 |
| TUFM | NM_003321.3 | Forward Primer | GTATCACCATCAATGCGGC | SEQ ID NO: 2146 |
| | | Probe | CATGTGGAGTATAGCACTGCCGCC | SEQ ID NO: 2147 |
| | | Reverse Primer | CAGTCTGTGTGGGCGTAGTG | SEQ ID NO: 2148 |
| TULP3 | NM_003324.2 | Forward Primer | TGTGTATAGTCCTGCCCCTCAA | SEQ ID NO: 2149 |
| | | Probe | CCGGATTATCCGACATCTTACTGTGA | SEQ ID NO: 2150 |
| | | Reverse Primer | CCCGATCCATTCCCCTTTTA | SEQ ID NO: 2151 |
| tusc4 | NM_006545.4 | Forward Primer | GGAGGAGCTAAATGCCTCAG | SEQ ID NO: 2152 |
| | | Probe | ACTCATCAATGGCAGAGTGCACC | SEQ ID NO: 2153 |
| | | Reverse Primer | CCTTCAAGTGGATGGTGTTG | SEQ ID NO: 2154 |
| UBB | NM_018955.1 | Forward Primer | GAGTCGACCCTGCACCTG | SEQ ID NO: 2155 |
| | | Probe | AATTAACAGCCACCCCTCAGGCG | SEQ ID NO: 2156 |
| | | Reverse Primer | GCGAATGCCATGACTGAA | SEQ ID NO: 2157 |
| UBC | NM_021009.2 | Forward Primer | ACGCACCCTGTCTGACTACA | SEQ ID NO: 2158 |
| | | Probe | CATCCAGAAAGAGTCCACCCTGCA | SEQ ID NO: 2159 |
| | | Reverse Primer | ACCTCTAAGACGGAGCACCA | SEQ ID NO: 2160 |
| UBE2C | NM_007019.2 | Forward Primer | TGTCTGGCGATAAAGGGATT | SEQ ID NO: 2161 |
| | | Probe | TCTGCCTTCCCTGAATCAGACAACC | SEQ ID NO: 2162 |
| | | Reverse Primer | ATGGTCCCTACCCATTTGAA | SEQ ID NO: 2163 |

TABLE A-continued

| Gene | Accession | Reagent | Sequence | Sequence ID Number |
|---|---|---|---|---|
| UBE2M | NM_003969.1 | Forward Primer<br>Probe<br>Reverse Primer | CTCCATAATTTATGGCCTGCAGTA<br>TCTTCTTGGAGCCCAACCCCGAG<br>TGCGGCCTCCTTGTTCAG | SEQ ID NO: 2164<br>SEQ ID NO: 2165<br>SEQ ID NO: 2166 |
| UBL1 | NM_003352.3 | Forward Primer<br>Probe<br>Reverse Primer | GTGAAGCCACCGTCATCATG<br>CTGACCAGGAGGCAAAACCTTCAACTGA<br>CCTTCCTTCTTATCCCCCAAGT | SEQ ID NO: 2167<br>SEQ ID NO: 2168<br>SEQ ID NO: 2169 |
| UCP2 | NM_003355.2 | Forward Primer<br>Probe<br>Reverse Primer | ACCATGCTCCAGAAGGAGG<br>CCCCGAGCCTTCTACAAAGGGTTC<br>AACCCAAGCGGAGAAAGG | SEQ ID NO: 2170<br>SEQ ID NO: 2171<br>SEQ ID NO: 2172 |
| UGT1A1 | NM_000463.2 | Forward Primer<br>Probe<br>Reverse Primer | CCATGCAGCCTGGAATTTG<br>CTACCCAGTGCCCCAACCCATTCTC<br>GAGAGGCCTGGGCACGTA | SEQ ID NO: 2173<br>SEQ ID NO: 2174<br>SEQ ID NO: 2175 |
| UMPS | NM_000373.1 | Forward Primer<br>Probe<br>Reverse Primer | TGCGGAAATGAGCTCCAC<br>CCCTGGCCACTGGGACTACACTA<br>CCTCAGCCATTCTAACCGC | SEQ ID NO: 2176<br>SEQ ID NO: 2177<br>SEQ ID NO: 2178 |
| UNC5A | XM_030300.7 | Forward Primer<br>Probe<br>Reverse Primer | GACAGCTGATCCAGGAGCC<br>CGGGTCCTGCACTTCAAGGACAGT<br>ATGGATAGGCGCAGGTTG | SEQ ID NO: 2179<br>SEQ ID NO: 2180<br>SEQ ID NO: 2181 |
| UNC5B | NM_170744.2 | Forward Primer<br>Probe<br>Reverse Primer | AGAACGGAGGCCGTGACT<br>CGGGACGCTGCTCGACTCTAAGAA<br>CATGCACAGCCCATCTGT | SEQ ID NO: 2182<br>SEQ ID NO: 2183<br>SEQ ID NO: 2184 |
| UNC5C | NM_003728.2 | Forward Primer<br>Probe<br>Reverse Primer | CTGAACACAGTGGAGCTGGT<br>ACCTGCCGCACACAGAGTTTGC<br>CTGGAAGATCTGCCCTTCTC | SEQ ID NO: 2185<br>SEQ ID NO: 2186<br>SEQ ID NO: 2187 |
| upa | NM_002658.1 | Forward Primer<br>Probe<br>Reverse Primer | GTGGATGTGCCCTGAAGGA<br>AAGCCAGGCGTCTACACGAGAGTCTCAC<br>CTGCGGATCCAGGGTAAGAA | SEQ ID NO: 2188<br>SEQ ID NO: 2189<br>SEQ ID NO: 2190 |
| UPP1 | NM_003364.2 | Forward Primer<br>Probe<br>Reverse Primer | ACGGGTCCTGCCTCAGTT<br>TCAGCTTTCTCTGCATTGGCTCCC<br>CGGGGCAATCATTGTGAC | SEQ ID NO: 2191<br>SEQ ID NO: 2192<br>SEQ ID NO: 2193 |
| VCAM1 | NM_001078.2 | Forward Primer<br>Probe<br>Reverse Primer | TGGCTTCAGGAGCTGAATACC<br>CAGGCACACACAGGTGGGACACAAAT<br>TGCTGTCGTGATGAGAAAATAGTG | SEQ ID NO: 2194<br>SEQ ID NO: 2195<br>SEQ ID NO: 2196 |
| VCL | NM_003373.2 | Forward Primer<br>Probe<br>Reverse Primer | GATACCACAACTCCCATCAAGCT<br>AGTGGCAGCCACGGCGCC<br>TCCCTGTTAGGCGCATCAG | SEQ ID NO: 2197<br>SEQ ID NO: 2198<br>SEQ ID NO: 2199 |
| VCP | NM_007126.2 | Forward Primer<br>Probe<br>Reverse Primer | GGCTTTGGCAGCTTCAGAT<br>AGCTCCACCCTGGTTCCCTGAAG<br>CTCCACTGCCCTGACTGG | SEQ ID NO: 2200<br>SEQ ID NO: 2201<br>SEQ ID NO: 2202 |
| VDAC1 | NM_003374.1 | Forward Primer<br>Probe<br>Reverse Primer | GCTGCGACATGGATTTCGA<br>TTGCTGGGCCTTCCATCCGG<br>CCAGCCCTCGTAACCTAGCA | SEQ ID NO: 2203<br>SEQ ID NO: 2204<br>SEQ ID NO: 2205 |
| VDAC2 | NM_003375.2 | Forward Primer<br>Probe<br>Reverse Primer | ACCCACGGACAGACTTGC<br>CGCGTCCAATGTGTATTCCTCCAT<br>AGCTTTGCCAAGGTCAGC | SEQ ID NO: 2206<br>SEQ ID NO: 2207<br>SEQ ID NO: 2208 |
| VDR | NM_000376.1 | Forward Primer<br>Probe<br>Reverse Primer | GCCCTGGATTTCAGAAAGAG<br>CAAGTCTGGATCTGGGACCCTTTCC<br>AGTTACAAGCCAGGGAAGGA | SEQ ID NO: 2209<br>SEQ ID NO: 2210<br>SEQ ID NO: 2211 |
| VEGF | NM_003376.3 | Forward Primer<br>Probe<br>Reverse Primer | CTGCTGTCTTGGGTGCATTG<br>TTGCCTTGCTGCTCTACCTCCACCA<br>GCAGCCTGGGACCACTTG | SEQ ID NO: 2212<br>SEQ ID NO: 2213<br>SEQ ID NO: 2214 |
| VEGF_altsplice1 | AF486837.1 | Forward Primer<br>Probe<br>Reverse Primer | TGTGAATGCAGACCAAAGAAAGA<br>AGAGCAAGACAAGAAAATCCCTGTGGGC<br>GCTTTCTCCGCTCTGAGCAA | SEQ ID NO: 2215<br>SEQ ID NO: 2216<br>SEQ ID NO: 2217 |
| VEGF_altsplice2 | AF214570.1 | Forward Primer<br>Probe<br>Reverse Primer | AGCTTCCTACAGCACAACAAAT<br>TGTCTTGCTCTATCTTTCTTTGGTCTGCA<br>CTCGGCTTGTCACATTTTTC | SEQ ID NO: 2218<br>SEQ ID NO: 2219<br>SEQ ID NO: 2220 |

TABLE A-continued

| Gene | Accession | Reagent | Sequence | Sequence ID Number |
|---|---|---|---|---|
| VEGFB | NM_003377.2 | Forward Primer | TGACGATGGCCTGGAGTGT | SEQ ID NO: 2221 |
| | | Probe | CTGGGCAGCACCAAGTCCGGA | SEQ ID NO: 2222 |
| | | Reverse Primer | GGTACCGGATCATGAGGATCTG | SEQ ID NO: 2223 |
| VEGFC | NM_005429.2 | Forward Primer | CCTCAGCAAGACGTTATTTGAAATT | SEQ ID NO: 2224 |
| | | Probe | CCTCTCTCTCAAGGCCCCAAACCAGT | SEQ ID NO: 2225 |
| | | Reverse Primer | AAGTGTGATTGGCAAAACTGATTG | SEQ ID NO: 2226 |
| VIM | NM_003380.1 | Forward Primer | TGCCCTTAAAGGAACCAATGA | SEQ ID NO: 2227 |
| | | Probe | ATTTCACGCATCTGGCGTTCCA | SEQ ID NO: 2228 |
| | | Reverse Primer | GCTTCAACGGCAAAGTTCTCTT | SEQ ID NO: 2229 |
| WIF | NM_007191.2 | Forward Primer | TACAAGCTGAGTGCCCAGG | SEQ ID NO: 2230 |
| | | Probe | TACAAAAGCCTCCATTTCGGCACC | SEQ ID NO: 2231 |
| | | Reverse Primer | CACTCGCAGATGCGTCTTT | SEQ ID NO: 2232 |
| WISP1 | NM_003882.2 | Forward Primer | AGAGGCATCCATGAACTTCACA | SEQ ID NO: 2233 |
| | | Probe | CGGGCTGCATCAGCACACGC | SEQ ID NO: 2234 |
| | | Reverse Primer | CAAACTCCACAGTACTTGGGTTGA | SEQ ID NO: 2235 |
| Wnt-3a | NM_033131.2 | Forward Primer | ACAAAGCTACCAGGGAGTCG | SEQ ID NO: 2236 |
| | | Probe | TTTGTCCACGCCATTGCCTCAG | SEQ ID NO: 2237 |
| | | Reverse Primer | TGAGCGTGTCACTGCAAAG | SEQ ID NO: 2238 |
| Wnt-5a | NM_003392.2 | Forward Primer | GTATCAGGACCACATGCAGTACATC | SEQ ID NO: 2239 |
| | | Probe | TTGATGCCTGTCTTCGCGCCTTCT | SEQ ID NO: 2240 |
| | | Reverse Primer | TGTCGGAATTGATACTGGCATT | SEQ ID NO: 2241 |
| Wnt-5b | NM_032642.2 | Forward Primer | TGTCTTCAGGGTCTTGTCCA | SEQ ID NO: 2242 |
| | | Probe | TTCCGTAAGAGGCCTGGTGCTCTC | SEQ ID NO: 2243 |
| | | Reverse Primer | GTGCACGTGGATGAAAGAGT | SEQ ID NO: 2244 |
| WNT2 | NM_003391.1 | Forward Primer | CGGTGGAATCTGGCTCTG | SEQ ID NO: 2245 |
| | | Probe | CTCCCTCTGCTCTTGACCTGGCTC | SEQ ID NO: 2246 |
| | | Reverse Primer | CCATGAAGAGTTGACCTCGG | SEQ ID NO: 2247 |
| WWOX | NM_016373.1 | Forward Primer | ATCGCAGCTGGTGGGTGTA | SEQ ID NO: 2248 |
| | | Probe | CTGCTGTTTACCTTGGCGAGGCCTTT | SEQ ID NO: 2249 |
| | | Reverse Primer | AGCTCCCTGTTGCATGGACTT | SEQ ID NO: 2250 |
| XPA | NM_000380.2 | Forward Primer | GGGTAGAGGGAAAAGGGTTC | SEQ ID NO: 2251 |
| | | Probe | CAAAGGCTGAACTGGATTCTTAACCAAGA | SEQ ID NO: 2252 |
| | | Reverse Primer | TGCACCACCATTGCTATTATT | SEQ ID NO: 2253 |
| XPC | NM_004628.2 | Forward Primer | GATACATCGTCTGCGAGGAA | SEQ ID NO: 2254 |
| | | Probe | TTCAAAGACGTGCTCCTGACTGCC | SEQ ID NO: 2255 |
| | | Reverse Primer | CTTTCAATGACTGCCTGCTC | SEQ ID NO: 2256 |
| XRCC1 | NM_006297.1 | Forward Primer | GGAGATGAAGCCCCCAAG | SEQ ID NO: 2257 |
| | | Probe | AGAAGCAACCCCAGACCAAAACCA | SEQ ID NO: 2258 |
| | | Reverse Primer | GTCCAGCTGCCTGAGTGG | SEQ ID NO: 2259 |
| YB-1 | NM_004559.1 | Forward Primer | AGACTGTGGAGTTTGATGTTGTTGA | SEQ ID NO: 2260 |
| | | Probe | TTGCTGCCTCCGCACCCTTTTCT | SEQ ID NO: 2261 |
| | | Reverse Primer | GGAACACCACCAGGACCTGTAA | SEQ ID NO: 2262 |
| YWHAH | NM_003405.2 | Forward Primer | CATGGCCTCCGCTATGAA | SEQ ID NO: 2263 |
| | | Probe | AGGTTCATTCAGCTCTGTCACCGC | SEQ ID NO: 2264 |
| | | Reverse Primer | GGAGATTTCGATCTTCATTGGA | SEQ ID NO: 2265 |
| zbtb7 | NM_015898.2 | Forward Primer | CTGCGTTCACACCCCAGT | SEQ ID NO: 2266 |
| | | Probe | TCTCTCCAGAACAGCTCGCCCTGT | SEQ ID NO: 2267 |
| | | Reverse Primer | CTCAGCCACGACAGATGGT | SEQ ID NO: 2268 |
| ZG16 | NM_152338.1 | Forward Primer | TGCTGAGCCTCCTCTCCTT | SEQ ID NO: 2269 |
| | | Probe | TACTCCTCATCACAGTGCCCCTGC | SEQ ID NO: 2270 |
| | | Reverse Primer | GGATGGGGGTTAGTGATAAGG | SEQ ID NO: 2271 |

TABLE B

| Gene | Locus Link | Sequence | Sequence ID Number |
|---|---|---|---|
| A-Catenin | NM_001903.1 | CGTTCCGATCCTCTATACTGCATCCCAGGCATGCCTACAGCACCCTGATGTCGCAGCCTATAAGGCCAACAGGGACCT | SEQ ID NO: 2272 |
| ABCB1 | NM_000927.2 | AAACACCACTGGAGCATTGACTACCAGGCTCGCCAATGATGCTGCTCAAGTTAAAGGGGCTATAGGTTCCAGGCTTG | SEQ ID NO: 2273 |
| ABCC5 | NM_005688.1 | TGCAGACTGTACCATGCTGACCATTGCCCATCGCCTGCACACGGTTCTAGGCTCCGATAGGATTATGGTGCTGGCC | SEQ ID NO: 2274 |
| ABCC6 | NM_001171.2 | GGATGAACCTCGACCTGCTGCAGGAGCACTCGGACGAGGCTATCTGGGCAGCCCTGGAGACGGTGCAGCTC | SEQ ID NO: 2275 |
| ACP1 | NM_004300.2 | GCTACCAAGTCCGTGCTGTTTGTGTGTCTGGGTAACATTTGTCGATCACCCATTGCAGAAGCAGTTTTC | SEQ ID NO: 2276 |
| ADAM10 | NM_001110.1 | CCCATCAACTTGTGCCAGTACAGGGTCTGTGCAGTGGAGTAGGCACTTCAGTGGTCGAACCATCACC | SEQ ID NO: 2277 |
| ADAM17 | NM_003183.3 | GAAGTGCCAGGAGGCGATTAATGCTACTTGCAAAGGCGTGTCCTACTGCACAGGTAATAGCAGTGAGTGCCCG | SEQ ID NO: 2278 |
| ADAMTS12 | NM_030955.2 | GGAGAAGGGTGGAGTGCAGCACCCAGATGGATTCTGACTGTGCGGCCATCCAGAGACCTGACCCTG | SEQ ID NO: 2279 |
| ADPRT | NM_001618.2 | TTGACAACCTGCTGGACATCGAGGTGGCCTACAGTCTGCTCAGGGGAGGGTCTGATGATAGCAGCAAGGATCCCAT | SEQ ID NO: 2280 |
| AGXT | NM_000030.1 | CTTTTCCCTCCAGTGGCACCTCCTGGAAACAGTCCACTTGGGCGCAAAACCCAGTGCCTTCCAAAT | SEQ ID NO: 2281 |
| AKAP12 | NM_005100.2 | TAGAGAGCCCCTGACAATCCTGAGGCTTCATCAGGAGCTAGAGCCATTTAACATTTCCTCTTTCCAAGACCAACC | SEQ ID NO: 2282 |
| AKT1 | NM_005163.1 | CGCTTCTATGGCGCTGAGATTGTGTCAGCCCTGGACTACCTGCACTCGGAGAAGAACGTGGTGTACCGGGA | SEQ ID NO: 2283 |
| AKD2 | NM_001626.2 | TCCTGCCACCCTTCAAACCTCAGGTCACGTCCGAGGTCGACACAAGGTACTTCGATGATGAATTTACCGCC | SEQ ID NO: 2284 |
| AKT3 | NM_005465.1 | TTGTCTGTGCCTTGGACTATCTACATTCCGGAAAGATTGTGTACCGTGATCTCAAGTTGGAGAATCTAATGCTGG | SEQ ID NO: 2285 |
| AL137428 | AL137428.1 | CAAGAAGAGGCTCTACCCTGGGACTGGGAATTTCCAAGGCCACCTTTGAGGATCGCAGAGCTCATTT | SEQ ID NO: 2286 |
| ALCAM | NM_001627.1 | GAGGAATATGGAATCCAAGGGGGCCAGTTCCTGCCGTCTGCTCTTCTGCCTCTTGATCTCCGCCAC | SEQ ID NO: 2287 |
| ALDH1A1 | NM_000689.1 | GAAGGAGATAAGGAGGATGTTGACAAGGCAGTGAAGGCCGCAAGACAGGCTTTTCAGATTGGATCTCCGTGGCG | SEQ ID NO: 2288 |
| ALDOA | NM_000034.2 | GCCTGTACGTGCCAGCTCCCCGACTGCCAGAGCCTCAACTGTCTCTGCTTCGAGATCAAGCTCCGATGA | SEQ ID NO: 2289 |
| AMFR | NM_001144.2 | GATGGTTCAGCTCTGCAAGGATCGATTTGAATATCTTTCCTTCTCGCCCACCACGCCGATGAGCAGCCACGGTCGA | SEQ ID NO: 2290 |
| ANGPD2 | NM_001147.1 | CCGTGAAAGCTGCTCTGTAAAAGCTGACACAGCCCTCCCAAGTGAGCAGGACTGTTCTTCCCACTGCAA | SEQ ID NO: 2291 |
| ANTXR1 | NM_032208.1 | CTCCAGGTGTACCTCCAACCCTAGCCTTCTCCCACAGCTGCCTACAACAGAGTCTCCCAGCCTTCTC | SEQ ID NO: 2292 |
| ANXA1 | NM_000700.1 | GCCCCTATCCTACCTTCAATCCATCCTCGGATGTCGCTGCCTTGCATAAGGCCATAATGGTTAAAGG | SEQ ID NO: 2293 |
| ANXA2 | NM_004039.1 | CAAGACACTAAGGGCGACTACCAGAAAGCGCTGCTGTACCTGTGTGGTGGAGATGACTGAAGCCCGACACG | SEQ ID NO: 2294 |
| ANXA5 | NM_001154.2 | GCTCAAGCCTGGAAGATGACGTGGTGGGGACACTTCAGGGTACTACCAGCGGATGTTGGTGGTTCT | SEQ ID NO: 2295 |
| AP-1 (JUN official) | NM_002228.2 | GACTGCAAAGATGGAAACGACCTTCTATGACGATGCCCTCAACGCCTCGTTCCTCCCGTCCGAGAGCGGACCTTATGGCTA | SEQ ID NO: 2296 |

TABLE B-continued

| Gene | Locus Link | Sequence | Sequence ID Number |
|---|---|---|---|
| APC | NM_000038.1 | GGACAGCAGGAATGTGTTTCTCCATACAGGTCACGGGGA GCCAATGGTTCAGAAACAAATCGAGTGGGT | SEQ ID NO: 2297 |
| APEX-1 | NM_001641.2 | GATGAAGCCTTTCGCAAGTTCCTGAAGGGCCTGGCTTCC CGAAAGCCCCTTGTGCTGTGTGGAGACCT | SEQ ID NO: 2298 |
| APG-1 | NM_014278.2 | ACCCCGGCCTGTATATCATTGGGATCAAGAACTCGAGCCAT TGGAAATGCAGCAAAGAGCCAGATAG | SEQ ID NO: 2299 |
| APN (ANPEP official) | NM_001150.1 | CCACCTTGGACCAAAGTAAAGCGTGGAATCGTTACCGCCTCCCCA ACACGCTGAAACCCGATTCCTACCAGGTGACGCTGAGA | SEQ ID NO: 2300 |
| APOC1 | NM_001645.3 | GGAAACACACTGGAGGACAAGGCTCGGGAACTCATCAGCCGCA TCAAACAGAGTGAACTTTCTGCCAAGATGCG | SEQ ID NO: 2301 |
| AREG | NM_001657.1 | TGTGAGTGAAAATGCCTTCTAGTAGTGAACCGTCCTCGGGAGC CGACTATGACTACTCAGAAGAGTATGATAACGAACCACAA | SEQ ID NO: 2302 |
| ARG | NM_005158.2 | CGCAGTGCAGCTGAGTATCTGCTCAGCAGTCTAATCAATGGCAG CTTCCTGGTGCGAGAAAGTGAGAGTAGCCCTGGGCA | SEQ ID NO: 2303 |
| ARHF | NM_019034.2 | ACTGGCCCACTTAGTCCTCAAGCTCCCAACCTGCTGTCCCTC AAGCCCCGCTTCTACCAGCCTGTGGAGTTCAG | SEQ ID NO: 2304 |
| ATOH1 | NM_005172.1 | GCAGCCACCTGCAACTTTGCAGGCGAGAGAGCATCCCG TCTACCCGCCTGAGCTGTCCCTCCTGGA | SEQ ID NO: 2305 |
| ATP5A1 | NM_004046.3 | GATGCTGCCACTCAACAACTTTTGAGTCGTGGCGTGC GTCTAACTGAGTTGCTGAAGCAAGGACA | SEQ ID NO: 2306 |
| ATP5E | NM_006886.2 | CCGCTTTCGCTACAGCATGGTGGCCTACTGGAGAC AGGCTGGACTCAGCTACATCCGATACTCCCA | SEQ ID NO: 2307 |
| AURKB | NM_004217.1 | AGCTGCAGAAGAGCTGCACATTTGACGAGCAGCGAACA GCCACGATCATGGAGGAGTTGGCAGATGC | SEQ ID NO: 2308 |
| Axin 2 | NM_004655.2 | GGCTATGTCTTTGCACCAGCCACCAGCGCCAACGACA GTGAGATATCCAGTGATGCGCTGACGGAT | SEQ ID NO: 2309 |
| axin1 | NM_003502.2 | CCGTGTGACAGCATCGTTGTGGCGTACTACTTCTGCGG GGAACCCATCCCCTACCGCACCCTGGTGAG | SEQ ID NO: 2310 |
| B-Catenin | NM_001904.1 | GGCTCTTGTGCGTACTGTCCTTCGGGCTGGTGACAGGGAA GACATCACTGAGCCTGCCATCTGTGCTCTTCGTCATCTGA | SEQ ID NO: 2311 |
| BAD | NM_032989.1 | GGGTCAGGTGCCTCGAGATCGGGCTTGGGCCCAG AGCATGTTCCAGATCCCAGAGTTTGAGCCGAGTGAGCAG | SEQ ID NO: 2312 |
| BAG1 | NM_004323.2 | CGTTGTCAGCACTTGGAATACAAGATGGTTGCCGGGTCATGTTA ATTGGGAAAAAGAACAGTCCACAGGAAGAGGTTGAAC | SEQ ID NO: 2313 |
| BAG2 | NM_004282.2 | CTAGGGGCAAAAAGCATGACTGCTTTTTCCTGTCTGGCATGGAA TCACGCAGTCACCTTGGGCATTTAG | SEQ ID NO: 2314 |
| BAG3 | NM_004281.2 | GAAAGTAAGCCAGGCCCAGTTGGACCAGAACTCCCTCCTGG ACACATCCCAATTCAAGTGATCCGCAAAGAGGT | SEQ ID NO: 2315 |
| Bak | NM_001188.1 | CCATTCCCACCATTCTACCTGAGGCCAGGACGTCTGGGG TGTGGGGATTGGTGGGTCTATGTTCCC | SEQ ID NO: 2316 |
| Bax | NM_004324.1 | CCGCCGTGGACACAGACTCCCCCCGAGAGGTCTTTTTCCG AGTGGCAGCTGACATGTTTTCTGACGGCAA | SEQ ID NO: 2317 |
| BBC3 | NM_014417.1 | CCTGGAGGGTCCTGTACAATCTCATCATGGGACTCCTGC CCTTACCCAGGGGCCACAGAGCCCCCGAGATGGAGCCCAATTAG | SEQ ID NO: 2318 |
| BCAS1 | NM_003657.1 | CCCCGAGACAACGGAGATAAGTGCTGTTGCGGATGCCA ACGGAAAGAATCTTGGGAAAGAGGCCAAACCCGAG | SEQ ID NO: 2319 |
| Bcl2 | NM_000633.1 | CAGATGGACCTAGTACCCACTGAGATTTCCACGCCGAAG GACAGCGATGGGAAAAATGCCCTTAAATCATAGG | SEQ ID NO: 2320 |
| BCL2L10 | NM_020396.2 | GCTGGGATGGCTTTTGTCACTTCTTCAGGACCCCCT TTCCACTGGCTTTTTGGAGAAAACAGCTGGTCCAGGC | SEQ ID NO: 2321 |

TABLE B-continued

| Gene | Locus Link | Sequence | Sequence ID Number |
|---|---|---|---|
| BCL2L11 | NM_138621.1 | AATTACCAAGCAGCCGAAGACCACCCACGAATGGTTAT CTTACGACTGTTACGTTACATTGTCCGCCTG | SEQ ID NO: 2322 |
| BCL2L12 | NM_138639.1 | AACCCACCCCTGTCTTGGAGCTCCGGGTAGCTCTCAAAC TCGAGGCTGCGCACCCCCTTTCCCGTCAGCTGAG | SEQ ID NO: 2323 |
| Bclx | NM_001191.1 | CTTTTGTGGAACTCTATGGGAACAATGCAGCAGCCGAGAGC CGAAAGGGCCAGGAACGCTTCAACCGCTG | SEQ ID NO: 2324 |
| BCRP | NM_004827.1 | TGTACTGGCGAAGAATATTTGGTAAAGCAGGGCATCGATCTCT CACCCTGGGGCTTGTGGAAGAATCACGTGGC | SEQ ID NO: 2325 |
| BFGF | NM_007083.1 | CCAGGAAGAATGCTTAAGATGTGAGTGGATGGATCTCAATGA CCTGGCGAAGACTGAAAATACAACTCCCATCACCA | SEQ ID NO: 2326 |
| BGN | NM_001711.3 | GAGCTCCGCAAGGATGACTTCAAGGGTCTCCAGCACCTCT ACGCCCTCGTCCTGGTGAACAACAAG | SEQ ID NO: 2327 |
| BID | NM_001196.2 | GGACTGTGAGGTCAACAACGGTTCCAGCCTCAGGGATGAG TGCATCACAAACCTACTGGTGTTTGGCTTCC | SEQ ID NO: 2328 |
| BIK | NM_001197.3 | ATTCCTATGGCTCTGCAATTGTCACCGGTTAACTGTGGC CTGTGCCCAGGAAGAGCCATTCACTCCTGCC | SEQ ID NO: 2329 |
| BIN1 | NM_004305.1 | CCTGCAAAAGGGAACAAGAGCCCTTCGCCTCCAGATGGCTCC CCTGCCGCCACCCCCGAGATCAGAGTCAACCACG | SEQ ID NO: 2330 |
| BLMH | NM_000386.2 | GGTTGCTGCCTCCATCAAAGATGGAGAGGCTGTGTGGTTTGGCT GTGATGTTGGAAAACACTTCAATAGCAAGCTGG | SEQ ID NO: 2331 |
| BMP2 | NM_001200.1 | ATGTGGACGCTCTTTCAATGGACGTGTCCCCGCGTGCTTCTTAG ACGGACTGCGGTCTCCTAAAGGTCGACCATGGT | SEQ ID NO: 2332 |
| BMP4 | NM_001202.2 | GGGCTAGCCATTGAGGTGACTCACCTCCATCAGACTCGGAC CCACCAGGGCCAGCATGTCAGGATTAGC | SEQ ID NO: 2333 |
| BMP7 | NM_001719.1 | TCGTGGAACATGACAAGGAATTCTTCCACCCACGCTACCACCA TCGAGAGTTCCGGTTTGATCTTTCCA | SEQ ID NO: 2334 |
| BMPR1A | NM_004329.2 | TTGGTTCAGCGAACTATTGCCAAACAGATTCAGATGG TCCGGCAAGTTGGTAAAGGCCGATATGGAGA | SEQ ID NO: 2335 |
| BRAF | NM_004333.1 | CCTTCCGACCAGCAGATGAAGATCATCGAAATCAATTTGGGCAA CGAGACCGATCCTCATCAGCTCCCAATGTGCATATAAA | SEQ ID NO: 2336 |
| BRCA1 | NM_007295.1 | TCAGGGGGCTAGAAATCTGTTGCTATGGGCCCTTCA CCAACATGCCCACAGATCAACTGGAATGG | SEQ ID NO: 2337 |
| BRCA2 | NM_000059.1 | AGTTCGTGCTTTGCAAGATGGTGCAGAGCTTTATGAAGCA GTGAAGAATGCAGCAGACCCAGCTTACCTT | SEQ ID NO: 2338 |
| BRK | NM_005975.1 | GTGCAGGAAAGGTTCACAAATGTGGAGTGTCTGCG TCCAATACACGCGTGTGCTCCTCTCCTTACTCCATCGTGTGTGC | SEQ ID NO: 2339 |
| BTF3 | NM_001207.2 | CAGTGATCCACTTTAACAACCCTAAAGTTCAGGCATCTCTGG CAGCGAACACTTTCACCATTACAGGCCATGCT | SEQ ID NO: 2340 |
| BTRC | NM_033637.2 | GTTGGGACACAGTTGGTCTGCAGTCGGCCCAGGACG GTCTACTCAGCACAACTGACTGCTTCA | SEQ ID NO: 2341 |
| BUB1 | NM_004336.1 | CCGAGGTTAATCCAGCACGTATGGGCCAAGTGTAGGCTC CCAGCAGGAACTGAGAGCGCCATGTCTT | SEQ ID NO: 2342 |
| BUB1B | NM_001211.3 | TCAACAGAAGGCTGAACCACTAGAAAGACTACAGTCCCAGCA CCGACAATTCCAAGCTCGAGTGTCTCGGCAAACTCTGTTG | SEQ ID NO: 2343 |
| BUB3 | NM_004725.1 | CTGAAGCAGATGGTTCATCATTTCCTGGGCTGTTAAACAAAGCG AGGTTAAGGTTAGACTCTTGGGAATCAGC | SEQ ID NO: 2344 |
| c-abl | NM_005157.2 | CCATCTCGCTGAGATACGAAGGGAGGGTGTACCATTACAGGA TCAACACTGCTTCTGATGGCAAGCTCTACGTCT | SEQ ID NO: 2345 |
| c-kit | NM_000222.1 | GAGGCAACTGCTTATGGCTTAATTAAGTCAGATGCGGCCATGACTG TCGCTGTAAAGATGCTCAAGCCGAGTGCC | SEQ ID NO: 2346 |

TABLE B-continued

| Gene | Locus Link | Sequence | Sequence ID Number |
|---|---|---|---|
| c-myb (MYB official) | NM_005375.1 | AACTCAGACTTGGAAATGCCTTCTTTAACTTCCACCCCCCTC ATTGGTCACAAATTGACTGTTACAACACCATTTCATAGAGACCAG | SEQ ID NO: 2347 |
| c-Src | NM_005417.3 | TGAGGAGTGGTATTTTGGCAAGATCACCAGACGGGAGTCAGA GCGGTTACTGCTCAATGCAGAGAACCCGAGAG | SEQ ID NO: 2348 |
| C20 orf1 | NM_012112.2 | TCAGCTGTGAGCTGCGGATACCGCCCGGCAAT GGGACCTGCTCTTAACCTCAAACCTAGGACCGT | SEQ ID NO: 2349 |
| C20ORF126 | NM_030815.2 | CCAGCACTGCTCGTTACTGTCTGCCTTCAGTGGTCTG AGGTCCCAGTATGAACTGCCGTGAAGTCAA | SEQ ID NO: 2350 |
| C8orf4 | NM_020130.2 | CTACGAGTCAGCCCATCCATCCATGGCTACCACTTCGACA CAGCCTCTCGTAAGAAAGCCGTGGGCA | SEQ ID NO: 2351 |
| CA9 | NM_001216.1 | ATCCTAGCCCTGGTTTTTGGCCTCCTTTTTGCTGTCACCAGCG TCGCGTTCCTTGTGCAGATGAGAAGGCAG | SEQ ID NO: 2352 |
| Cad17 | NM_004063.2 | GAAGGCCAAGAACCGAGTCAAATTATATTCCAGTTTAAGGCCAA TCCTCCTGCTGTGACTTTTGAACTAACTGGGGA | SEQ ID NO: 2353 |
| CALD1 | NM_004342.4 | CACTAAGGTTTGAGACAGTTCCAGAAAGAACCCAAGCTCAA GACGCAGGACGAGCTCAGTTGTAGAGGGCTAATTCGC | SEQ ID NO: 2354 |
| CAPG | NM_001747.1 | GATTGTCACTGATGGGGAGGAGCCTGCTGAGATGATCCA GGTCCTGGGCCCCAAGCCTGCTCTGAAGG | SEQ ID NO: 2355 |
| CAPN1 | NM_005186.2 | CAAGAAGCTGTACGAGCTCATCATCACCCGCTACTCGGAGCCCGAC CTGGCGGTCGACTTTGACAATTTCGTTTGCTGC | SEQ ID NO: 2356 |
| CASP8 | NM_033357.1 | CCTCGGGGATACTGTCTGATCATCAACAATCACAATTTTG CAAAAGCACGGGAGAAAGTGCCCAAACTTC | SEQ ID NO: 2357 |
| CASP9 | NM_001229.2 | TGAATGCCGTGGATTGCACGTGGCCTCTTGAGCAGTGGCTG GTCCAGGGCTAGTGACTTGTGTCCCATGATCCCTGT | SEQ ID NO: 2358 |
| CAT | NM_001752.1 | ATCCATTCGATCTCACCAAGGTTTGGCCTCACAAGGACTACCCT CTCATCCCAGTTGGTAAACTGGTCTTAAACCGGA | SEQ ID NO: 2359 |
| CAV1 | NM_001753.3 | GTGGCTCAACATTGTGTTCCCATTTCAGCTGATCAGTGGGCCTC CAAGGAGGGGCTGTAAAATGGAGGCCATTG | SEQ ID NO: 2360 |
| CBL | NM_005188.1 | TCATTCACAAACCTGGCAGTTATATCTTCCGGCTGAGCTGTACTC GTCTGGGTCAGTGGGCTATTGGGTATG | SEQ ID NO: 2361 |
| CCL20 | NM_004591.1 | CCATGTGCTGTACCAAGAGTTTGCTCCTGGCTGCTTTGATGTCA GTGCTGCTACTCCACCTCTGCGGCG | SEQ ID NO: 2362 |
| CCL3 | NM_002983.1 | AGCAGACAGTGGTCAGTCCTTTCTTGGCTCTGCTGACACTCGAGCCC ACATTCCGTCACCTGCTCAGAATCATGCAG | SEQ ID NO: 2363 |
| CCNA2 | NM_001237.2 | CCATACCTCAAGTATTTGCCATCAGTTATTGCTGGAGCTGCCTTTCA TTTAGCACTCTACACAGTCACGGGACAAAGCT | SEQ ID NO: 2364 |
| CCNB1 | NM_031966.1 | TTCAGGTTGTTGCAGGAGACCATGTACATGACTGTCTCCATTATTGA TCGGTTCATGCAGAATAATTGTGTGCCCAAGAAGATG | SEQ ID NO: 2365 |
| CCNB2 | NM_004701.2 | AGGCTTCTGCAGGAGACTCTGTACATGTGCGTTGGCATTATG GATCGATTTTTACAGGTTCAGCCAGTTTCCC | SEQ ID NO: 2366 |
| CCND1 | NM_001758.1 | GCATGTTCGTGGCCTCTAAGATGAAGGAGACCATCCCCCTGA CGGCCGAGAAGCTGTGCATCTACACCG | SEQ ID NO: 2367 |
| CCND3 | NM_001760.2 | CCTCTGTGCTACAGATTATACCTTTGCCATGTACCCGCCATCCATG ATCGCCACGGGCAGCATTGGGGCTGCAGTG | SEQ ID NO: 2368 |
| CCNE1 | NM_001238.1 | AAAGAAGATGATGACCGGGTTTACCCAAACTCAACGTGCAA GCCTCGGATTATTGCACCATCCAGAGGCTC | SEQ ID NO: 2369 |
| CCNE2 | NM_057749.1 | ATGCTGTGGCTCCTTCCTAACTGGGGCTTTCTTGACATGTAGGTT GCTTGGTAATAACCTTTTTGTATATCACAATTTGGGT | SEQ ID NO: 2370 |
| CCNE2 variant 1 | NM_057749var1 | GGTCACCAAGAAACATCAGTATGAAATTAGGAATTGTTGGCC ACCTGTATTATCTGGGGGATCAGTCCTTGCATTATCATTGAA | SEQ ID NO: 2371 |

TABLE B-continued

| Gene | Locus Link | Sequence | Sequence ID Number |
|---|---|---|---|
| CCR7 | NM_001838.2 | GGATGACATGCACTCAGCTCTTGGCTCCACTGGGATG GGAGGAGAGGACAAGGGAAATGTCAGG | SEQ ID NO: 2372 |
| CD105 | NM_000118.1 | GCAGGTGTCAGCAAGTATGATCAGCAATGAGGCGGTGGT CAATATCCTGTCGAGCTCATCACCACAGCGGAAAAA | SEQ ID NO: 2373 |
| CD134 (TNFRSF4 official) | NM_003327.1 | GCCCAGTGCGGAGAACAGGTCCAGCTTGATTCTCGTCTCTGC ACTTAAGCTGTTCTCCAGGTGCGTGTGATT | SEQ ID NO: 2374 |
| CD18 | NM_000211.1 | CGTCAGGACCCACCATGTCTGCCCCATCACGCGGCCGAGACATG GCTTGGCCACAGCTCTTGAGGATGTCACCAATTAACC | SEQ ID NO: 2375 |
| CD24 | NM_013230.1 | TCCAACTAATGCCACCACCAAGGCGGCTGGTGGTGCCCTGCAGTCAA CAGCCAGTCTCTTCGTGGTCTCACTCTCTC | SEQ ID NO: 2376 |
| CD28 | NM_006139.1 | TGTGAAAGGGAAACACCTTTGTCCAAGTCCCCTATTTCCCGGA CCTTCTAAGCCCTTTTGGGTGCT | SEQ ID NO: 2377 |
| CD31 | NM_000442.1 | TGTATTTCAAGACCTCTGTGCACTTATTTATGAACCTGCCCTGCT CCCACAGAACACAGCAATTCCTCAGGCTAA | SEQ ID NO: 2378 |
| CD34 | NM_001773.1 | CCACTGCACACACCTCAGAGGCTGTTCTTGGGGCCCTAC ACCTTGAGGAGGGGCAGGTAAACTCCTG | SEQ ID NO: 2379 |
| CD3z | NM_000734.1 | AGATGAAGTGGAAGGCGCTTTTCACCGCGGCCATCC TGCAGGCACAGTTGCCGATTACAGAGGCA | SEQ ID NO: 2380 |
| CD44E | X55150 | ATCACCGACAGCACAGACAGAATCCCTGCTACCAATATGGACT CCAGTCATAGTACAACGCTTCAGCCTACTGCAAATCAAACACAGGT | SEQ ID NO: 2381 |
| CD44s | M59040.1 | GACGAAGACAGTCCCTGGATCACCGACAGCACAGACAGAATCC CTGCTACCAGAGACCAAGACACATTCCACCCCAGT | SEQ ID NO: 2382 |
| CD44v3 | AJ251595v3 | CACACAAAACAGAACCAGGACTGGACCCAGTGGAAC CCAAGCCATTCAAATCCGGAAGTGCTACTTCAG | SEQ ID NO: 2383 |
| CD44v6 | AJ251595v6 | CTCATACCAGCCATCCAATGCAAGGAAGGACAACACCAAGCCCAG AGGACAGTTCCTGGACTGATTTCTTCAACCCAA | SEQ ID NO: 2384 |
| CD68 | NM_001251.1 | TGGTTCCCAGCCCTGTGTCCACCTCCAAGCCCAGA TTCAGATTCGAGTCATGTACACAACCCAGGGTGGAGGAG | SEQ ID NO: 2385 |
| CD80 | NM_005191.2 | TTCAGTTGCTTTGCAGGAAGTGTCTAGAGGAAT ATGGTGGGCACAGAAGTAGCTCTGGTGACCTTGATCAA | SEQ ID NO: 2386 |
| CD82 | NM_002231.2 | GTGCAGGCTCAGGTGAAGTGCTGCGGCTGGGTCAGC TTCTACAACTGGACAGACAACGCTGAGCTCATGAATCGCCCTGAGGTC | SEQ ID NO: 2387 |
| CD8A | NM_171827.1 | AGGGTGAGGTGCTTGAGTCTCCAACGGCAAGG GAACAAGTACTTCTTGATACCTGGGATACTGTGCCC | SEQ ID NO: 2388 |
| CD9 | NM_001769.1 | GGGCGTGGAACAGTTTATCTCAGACATCTGCCCCAAGA AGGACGTACTCGAAACCTTCACCGTG | SEQ ID NO: 2389 |
| CDC2 | NM_001786.2 | GAGAGCGACGCGGTTGTTGTAGCTGCCGCTGCGGCCGCC GCGGAATAATAAGCCGGGATCTACCATAC | SEQ ID NO: 2390 |
| CDC20 | NM_001255.1 | TGGATTGGAGTTCTGGGAATGTACTGGCCGTGGCACTGGACA ACAGTGTGTACCTGTGGAGTGCAAGC | SEQ ID NO: 2391 |
| cdc25A | NM_001789.1 | TCTTGCTGGCTACGCCTCTTCGTCCCTGTTAGACGT CCTCCGTCCATATCAGAACTGTGCCACAATGCAG | SEQ ID NO: 2392 |
| CDC25B | NM_021874.1 | AAACGAGCAGTTTGCCATCAGACGCTTCCAGTCTATGCCGGT GAGGCTGCTGGGCCACAGCCCCGTGCTTCGGAACATCACCAAC | SEQ ID NO: 2393 |
| CDC25C | NM_001790.2 | GGTGAGCAGAAGTGGCCTATATCGCTCCCCGTCGATG CCAGAGAACTTGAACAGGCCAAGACTGAAG | SEQ ID NO: 2394 |
| CDC4 | NM_018315.2 | GCAGTCCGCTGTGTTCAATATGATGGCAGGAGGGTTGTTA GTGGAGCATATGATTTATGGTAAAGGTGTGGGATCC | SEQ ID NO: 2395 |
| CDC42 | NM_001791.2 | TCCAGAGACTGCTGAAAAGCTGGCCCGTGACCTGAAGGCTG TCAAGTATGTGGAGTGTTCTGCACTTACACA | SEQ ID NO: 2396 |

TABLE B-continued

| Gene | Locus Link | Sequence | Sequence ID Number |
|---|---|---|---|
| CDC42BPA | NM_003607.2 | GAGCTGAAAGACGCACACTGTCAGAGGAAACTGGCCATGCA GGAATTCATGGAGATCAATGAGCGGC | SEQ ID NO: 2397 |
| CDC6 | NM_001254.2 | GCAACACTCCCCATTTACCTCCTTGTTCTCCACCAAAG CAAGGCAAGAAAGAGAATGGTCCCCCTCA | SEQ ID NO: 2398 |
| CDCA7 v2 | NM_145810.1 | AAGACCGTGGATGGCTACATGAATGAAGATGACCTGC CCAGAAGCCGTCGCTCCAGATCATCCGTGACCCT | SEQ ID NO: 2399 |
| CDH1 | NM_004360.2 | TGAGTGTCCCCCGGTATCTTCCCCGCCCTGCCAATCCCGATGAAAT TGGAAATTTTATTGATGAAAATCTGAAAGCGGCTG | SEQ ID NO: 2400 |
| CDH11 | NM_001797.2 | GTCGGCAGAAGCAGGACTTGTACCTTCTGCCCATAGTGATCAGCG ATGGCGGCATCCCGCCCATGAGTAG | SEQ ID NO: 2401 |
| CDH3 | NM_001793.3 | ACCCATGTACCGTCCTCGGCCAGCCAACCCAGATGAAATCGGCAA CTTTATAATTGAGAACCTGAAGGCGG | SEQ ID NO: 2402 |
| CDK2 | NM_001798.2 | AATGCTGCACTACGACCCTAACAAGCGGATTTCGGCCAAGGCAGCC CTGGCTCACCCTTTCTTCCAGGATGTGACCAA | SEQ ID NO: 2403 |
| CDX1 | NM_001804.1 | AGCAACACCAGCCTCCTGGCCACCTCCTCTCCAATGCCTGTGAAA GAGGAGTTTCTGCCATAGCCC | SEQ ID NO: 2404 |
| Cdx2 | NM_001265.2 | GGGCAGGCAAGGTTTACACTGCGGAAGCCAAAGGCAGCTAAG ATAGAAAGCTGGACTGACCAAAGAC | SEQ ID NO: 2405 |
| CEACAM1 | NM_001712.2 | ACTTGCCTGTTCAGAGCACTCATTCCTTCCCACCCCCAGTCCTGT CCTATCACTCTAATTCGGATTTGCCA | SEQ ID NO: 2406 |
| CEACAM6 | NM_002483.2 | CACAGCCTCACTTCTAACCTTCTGGAACCCACCCACCACTGCCAAG CTCACTATTGAATCCACGCCATTCAA | SEQ ID NO: 2407 |
| CEBPB | NM_005194.2 | GCAACCCACGTGTAACTGTCAGCCGGGCCCTGAGTAA TCGCTTAAAGATGTTCCTACGGGCTTGT | SEQ ID NO: 2408 |
| CEGP1 | NM_020974.1 | TGACAATCAGCACACCTGCATTCACCGCTCGGAAGAGGGCCTGA GCTGCATGAATAAGGATCACGGCTGTAGTCACA | SEQ ID NO: 2409 |
| CENPA | NM_001809.2 | TAAAATTCACTCGTGGTGTGGACTTCAATTGGCAAGC CCAGGCCCTATTGGCCCTACAAGAGGC | SEQ ID NO: 2410 |
| CENPE | NM_001813.1 | GGATGCTGGTGACCTCTTCTTCCCTCACGTTGCAACAGGAATTAA AGGCTAAAAGAAAACGAAGAGTTACTTGGTGCCTTGGC | SEQ ID NO: 2411 |
| CENPF | NM_016343.2 | CTCCCGTCAACAGCGTTCTTTCCAAACACTGGACCAGGAGT GCATCCAGATGAAGGCCAGACTCACCC | SEQ ID NO: 2412 |
| CES2 | NM_003869.4 | ACTTTGCGAGAAATGGGAACCCCAATGGCGAGGGTCTGCC ACACTGGCCGCTGTTCGACCAGGAGGAGCAATACCTG | SEQ ID NO: 2413 |
| CGA (CHGA official) | NM_001275.2 | CTGAAGGAGCTCCAAGACCTCGCTCTCCAAGGCGCCAA GGAGAGGGCACATCAGCAGAAGAAACACAGCGGTTTG | SEQ ID NO: 2414 |
| CGB | NM_000737.2 | CCACCATAGGCAGAGGCAGGCCTTCCTACACCCTACTCCCTGT GCCTCCAGCCTCGACTAGTCCCTAGCACTCGACGACT | SEQ ID NO: 2415 |
| CHAF1B | NM_005441.1 | GAGGCCAGTGGTGGAAACAGGTGTGGAGCTGATGAGTCTGC CCTACCGCCTGGTGTTTGCTGTGGCCTCGGA | SEQ ID NO: 2416 |
| CHD2 | NM_001271.1 | CTCTGTGCGAGGCTGTCAGCCACACTAGGTATCAGGGATC CCGAGATGGGTACCAGCCCACAGTCCTTACC | SEQ ID NO: 2417 |
| CHFR | NM_018223.1 | AAGGAAGTGGTCCCTCTGTGGCAAGTGATGAAGTCTCC AGCTTTGCCTCAGCTCTCCCAGACAGAAAGACTGCGTC | SEQ ID NO: 2418 |
| Chk1 | NM_001274.1 | GATAAATTGGTACAAGGGATCAGCTTTTCCCAGCCCACATGTCCT GATCATATGCTTTTGAATAGTCAGTTACTTGGCACCC | SEQ ID NO: 2419 |
| Chk2 | NM_007194.1 | ATGTGGAACCCCCACCTACTTGGCGCCTGAAGTTCTTGTTTCTGT TGGGACTGCTGGGTATAACCGTGCTGTGGACTG | SEQ ID NO: 2420 |
| CIAP1 | NM_001166.2 | TGCCTGTGGTGGGAAGCTCAGTAACTGGGAACCAAAGGATGA TGCTATGTCAGAACACCGGAGGCATTTTCC | SEQ ID NO: 2421 |

TABLE B-continued

| Gene | Locus Link | Sequence | Sequence ID Number |
|---|---|---|---|
| cIAP2 | NM_001165.2 | GGATATTTCCGTGGCTCTTATTCAAACTCTCCATCAAATCCTGTAA ACTCCAGAGCAAATCAAGATTTTTCTGCCTTGATGAGAAG | SEQ ID NO: 2422 |
| CKS1B | NM_001826.1 | GGTCCCTAAAACCCATCTGATGTCTGAATCTGAATGGAGGAATC TTGGCGTTCAGCAGAGTCAGGGATGGGTCCATTA | SEQ ID NO: 2423 |
| CKS2 | NM_001827.1 | GGCTGGACGTGGTTTTGTCTGCTGCGCCCGCTCTTCGCGCTC TCGTTTCATTTTCTGCAGCG | SEQ ID NO: 2424 |
| Claudin 4 | NM_001305.2 | GGCTGCTTTGCTGCAACTGTCCACCCCGCACAGACAAGCCTTA CTCCGCCAAGTATTCTGCTGCCCGCTCTG | SEQ ID NO: 2425 |
| CLDN1 | NM_021101.3 | TCTGGGAGGTGCCCTACTTTGCTGTTCCTGTCCCCGAAAAACAA CCTCTTACCCAACACCAAGGCCCTATCCA | SEQ ID NO: 2426 |
| CLDN7 | NM_001307.3 | GGTCTGCCCTAGTCATCCTGGGAGGTGCACTGCTCTCCTGTT CCTGTCCTGGGAATGAGAGCAAGGCTGGGTAC | SEQ ID NO: 2427 |
| CLIC1 | NM_001288.3 | CGGTACTTGAGCAATGCCTACGCCCGGGAAGAATTCGCTT CCACCTGTCCAGATGATGAGGAGATCGA | SEQ ID NO: 2428 |
| CLTC | NM_004859.1 | ACCGTATGGACAGCCACAGCCTGGCTTTGGGTACAGCATGT GAGATGAAGCGCTGATCCTGTAGTCA | SEQ ID NO: 2429 |
| CLU | NM_001831.1 | CCCCAGGATACCTACCACTACCTGCCCTTCAGCCTGCCCCACCG GAGGCCTCACTTCTTCTTTCCCAAGTCCCGCA | SEQ ID NO: 2430 |
| cMet | NM_000245.1 | GACATTTCCAGTCCTGCAGTCAATGCCTCTCTGCCCCACCCTTT GTTCAGTGTGGCTGGTGCCACGACAAATGTGTGCGATCGGAG | SEQ ID NO: 2431 |
| cMYC | NM_002467.1 | TCCCTCCACTCGGAAGGACTATCCTGCTGCCAAGAGGGTCAAGTTGG ACAGTGTCAGAGTCCTGAGACAGATCAGCAACAACCG | SEQ ID NO: 2432 |
| CNN | NM_001299.2 | TCCACCCTCCTGGCTTTGGCCAGCATGGCGAAGACGAAAG GAAACAAGGTGAACGTGGGAGTGA | SEQ ID NO: 2433 |
| COL1A1 | NM_000088.2 | GTGGCCATCCAGCTGACCTTCCTGCGCCTGATGTCCACC GAGGCCTCCCAGAACATCACCTACCACTG | SEQ ID NO: 2434 |
| COL1A2 | NM_000089.2 | CAGCCAAGAACTGGTATAGGAGCTCCAAGGACAAGAAACACGTC TGGCTAGGAGAAACTATCAATGCTGGCAGCCAGTTT | SEQ ID NO: 2435 |
| COPS3 | NM_003653.2 | ATGCCCAGTGTTCCTGACTTCGAAACGCTATTCTCACAGG TTCAGCTCTTCATCAGCACTTGTAATGGGGAG | SEQ ID NO: 2436 |
| COX2 | NM_000963.1 | TCTGCAGAGTTGGAAGCACTCTATGGTGACATCGATGC TGTGGAGCTGTATCCTGCCCTTCGGTAGAAAAGCCTCGGC | SEQ ID NO: 2437 |
| COX3 | MITO_COX3 | TCGAGTCTCCCTTCACCATTTCCGACGGCATCTACGGCTC AACATTTTTTGTAGCCACAGGCTTCCACGGACTTCACGTC | SEQ ID NO: 2438 |
| CP | NM_000096.1 | CGTGAGTACACAGATGCCTCCTTCACAAATCGAAAGGA GAGAGGCCCTGAAGAAGAGCATCTTGGCATCCTGG | SEQ ID NO: 2439 |
| CRBP | NM_002899.2 | TGGTCTGCAAGCAAGTATTCAAGAAGGTGCAGTGAGGCCC AAGCAGACAACCTTGTCCCAACCAATCAGC | SEQ ID NO: 2440 |
| CREBBP | NM_004380.1 | TGGGAAGCAGCTGTGTACCATTCCTCGCGATGCTGCCTACTAC AGCTATCAGAATAGGTATCATTTCTGTGAGAAGTGTTTC | SEQ ID NO: 2441 |
| CRIP2 | NM_001312.1 | GTGCTACGCCACCCTGTTCGGACCCAAAGGCGTGA ACATCGGGGGCGCGGGCTCCTACATCTACGAGAAGCCCTG | SEQ ID NO: 2442 |
| cripto (TDGF1 official) | NM_003212.1 | GGGTCTGTGCCCCATGACACCTGGCTGCCCAA GAAGTGTTCCCTGTGTAAATGCTGGCACGGTCA | SEQ ID NO: 2443 |
| CRK(a) | NM_016823.2 | CTCCCTAACCTCCAGAATGGGCCCATATATGCCAGGGTT ATCCAGAAGCGAGTCCCCAATGCCTACGACAAGACA | SEQ ID NO: 2444 |
| CRMP1 | NM_001313.1 | AAGGTTTTTGGATTGCAAGGGGTTTCCAGGGGCATGTATGACG GTCCTGTGTACGAGGTACCAGCTACACCC | SEQ ID NO: 2445 |
| CRYAB | NM_001885.1 | GATGTGATTGAGGTGCATGGAAAACATGAAGAGCGCCAGGATGAA CATGGTTTCATCTCCAGGGAGTTC | SEQ ID NO: 2446 |

TABLE B-continued

| Gene | Locus Link | Sequence | Sequence ID Number |
|---|---|---|---|
| CSEL1 | NM_001316.2 | TTACGCAGCTCATGCTCTTGAACGGCTCTTTACTATGCGAGGGCC<br>TAACAATGCCACTCTCTTTACAGCTGC | SEQ ID NO: 2447 |
| CSF1 | NM_000757.3 | TGCAGCGGCTGATTGACAGTCAGATGGAGACCTCGTGCCAAATTAC<br>ATTTGAGTTTGTAGACCAGGAACAGTTG | SEQ ID NO: 2448 |
| CSK (SRC) | NM_004383.1 | CCTGAACATGAAGGAGCTGAAGCTGCTGCAGACCATCGGGA<br>AGGGGGAGTTCGGAGACGTGATG | SEQ ID NO: 2449 |
| CTAG1B | NM_001327.1 | GCTCTCCATCAGCTCCTGTCTCCAGCAGCTTTCCCTGTTGATGT<br>GGATCACGCAGTGCTTTCTGCCCGTGTT | SEQ ID NO: 2450 |
| CTGF | NM_001901.1 | GAGTTCAAGTGCCCTGACGGCGAGGTCATGAAGAAGAACATGATG<br>TTCATCAAGACCTGTGCCTGCCATTACAACT | SEQ ID NO: 2451 |
| CTHRC1 | NM_138455.2 | GCTCACTTCGGCTAAAATGCAGAAATGCATGCTGTCAGC<br>GTTGGTATTTCACATTCAATGGAGCTGA | SEQ ID NO: 2452 |
| CTLA4 | NM_005214.2 | CACTGAGGTCCGGGTGACAGTGCTTCGGCAGGCTGACAGCCAG<br>GTGACTGAAGTCTGTGCGGCAACCTAC | SEQ ID NO: 2453 |
| CTNNBIP1 | NM_020248.2 | GTTTTCCAGGTCGGAGACGGAAGACCGGAGGCAGTAGCTG<br>CAAAGCCCTTGGAACACCCTGGATGCT | SEQ ID NO: 2454 |
| CTSB | NM_001908.1 | GGCCGAGATCTACAAAAACGGCCCCGTGGAGGGAGCTT<br>TCTCTGTGTATTCGGACTTCCTGC | SEQ ID NO: 2455 |
| CTSD | NM_001909.1 | GTACATGATCCCCTGTGAGAAGGTGTCCACCCTGCCCGCGATCACA<br>CTGAAGCTGGGAGGCAAAGGCTACAAGCTGTCCC | SEQ ID NO: 2456 |
| CTSH | NM_004390.1 | GCAAGTTCCAACCTGGAAAGGCCATCGGCTTTGTCAAGGATGT<br>AGCCAACATCACAATCTATGACGAGGAAGCGATG | SEQ ID NO: 2457 |
| CTSL | NM_001912.1 | GGGAGGCTTATCTCACTGAGTGAGCAGAATCTGGTAGACTG<br>CTCTGGGCCTCAAGGCAATGAAGGCTGCAATGG | SEQ ID NO: 2458 |
| CTSL2 | NM_001333.2 | TGTCTCACTGAGCGAGCAGAATCTGGTGGACTGTTCGCGTCCT<br>CAAGGCAATCAGGGCTGCAATGGT | SEQ ID NO: 2459 |
| CUL1 | NM_003592.2 | ATGCCCTGGTAATGTCTGCATTCAACAATGACGCTGGCTTT<br>GTGGCTGCTCTTGATAAGGCTTGTGGTCGC | SEQ ID NO: 2460 |
| CUL4A | NM_003589.1 | AAGCATCTTCCTGTTCTTGGACCGCACCTATGTGCTGCAGAAC<br>TCCACGCTGCCCTCCATCTGGGATATGGGATT | SEQ ID NO: 2461 |
| CXCL12 | NM_000609.3 | GAGCTACAGATGCCCATGCCGATTCTTCGAAAGCCATGTTGC<br>CAGAGCCAACGTCAAGCATCTCAAA | SEQ ID NO: 2462 |
| CXCR4 | NM_003467.1 | TGACCGCTTCTACCCCAATGACTTGTGGGTGGTTGTGT<br>TCCAGTTTCAGCACATATGGTTGGCCTTATCCT | SEQ ID NO: 2463 |
| CYBA | NM_000101.1 | GGTGCCTACTCCATTGTGGCGGGCGTGTTTGTGTGCCTGCTG<br>GAGTACCCCCGGGGGAAGAGGAAGAAGGGCTCCAC | SEQ ID NO: 2464 |
| CYP1B1 | NM_000104.2 | CCAGCTTTGTGCCTGTCACTATTCCTCATGCCACCACTGC<br>CAACACCTCTGTCTTGGGCTACCACATTCCC | SEQ ID NO: 2465 |
| CYP2C8 | NM_000770.2 | CCGTGTTCAAGAGGAAGCTCACTGCCTTGTGGAGGAGTTGAGAAA<br>AACCAAGGCTTCACCCTGTGATCCCACT | SEQ ID NO: 2466 |
| CYP3A4 | NM_017460.3 | AGAACAAGGACAACATAGATCCTTACATAT<br>ACACACCCTTTGGAAGTGGACCCAGAAACTGCATTGGCATGAGGTTTGC | SEQ ID NO: 2467 |
| CYR61 | NM_001554.3 | TGCTCATTCTTGAGGAGCATTAAGGTATTTCGAAACTGCCAAGGGT<br>GCTGGTGCGGATGGACACTAATGCAGCCAC | SEQ ID NO: 2468 |
| DAPK1 | NM_004938.1 | CGCTGACATCATGAATGTTCCTCGACCGGCTGGAGGCGAGTTTGG<br>ATATGACAAAGACACATCGTTGCTGAAAGAGA | SEQ ID NO: 2469 |
| DCC | NM_005215.1 | AAATGTCCTCCTCGACTGCTCCGCGGAGTCCGACCGAGGAGTTCCAG<br>TGATCAAGTGGAAGAAAGATGGCATTCA | SEQ ID NO: 2470 |
| DCC_exons18-23 | X76132_18-23 | GGTCACCGTTGGTGTCATCACAGTGCTGGTA<br>GTGGTCATCGTGGCTGTGATTTGCACCCGACGCTC | SEQ ID NO: 2471 |

TABLE B-continued

| Gene | Locus Link | Sequence | Sequence ID Number |
|---|---|---|---|
| DCC_exons6-7 | X76132_6-7 | ATGGAGATGTGGTCATTCCTAG TGATTATTTTCAGATAGTGGGAGGAAGCAACTTACGGATACTTGGGGTGGTG | SEQ ID NO: 2472 |
| DCK | NM_000788.1 | GCCGCCACAAGACTAAGGAATGGCCACCCCGCCCAAGAGA AGCTGCCCGTCTTTCTCAGCCAGCTCTGAGGGGACCCG CATCAAGAAATCTCCATCGAAGGGAACATCG | SEQ ID NO: 2473 |
| DDB1 | NM_001923.2 | TGCGGATCATCCGGAATGGAATTGGAATCCACGAGCA TGCCAGCATTGACTTACCAGGCATCAAAGGA | SEQ ID NO: 2474 |
| DET1 | NM_017996.2 | CTTGTGGAGATCACCCAATCAGGTTCTATGCCCGGGACTCGG GCCTGCTCAAGTTTGAGATCCAGGCGGG | SEQ ID NO: 2475 |
| DHFR | NM_000791.2 | TTGCTATAACTAAGTGCTTCTCCAAGACCCCAACTGAGTCC CCAGCACCTGCTACAGTGAGCTGCCATTCCAC | SEQ ID NO: 2476 |
| DHPS | NM_013407.1 | GGGAGAACGGGATCAATAGGATCGGAAACCTGCTGGTGCCC AATGAGAATTACTGCAAGTTTGAGGACTGGCTGATGC | SEQ ID NO: 2477 |
| DIABLO | NM_019887.1 | CACAATGGCGGCTCTGAAGAGTTGGCTGTCGCGCAG CGTAACTTCATTCTTCAGGTACAGACAGTGTTTGTGT | SEQ ID NO: 2478 |
| DIAPH1 | NM_005219.2 | CAAGCAGTCAAGGAGAACCAGAAGCGGCGGGAGACA GAAGAAAGATGAGGCGAGCAAAACT | SEQ ID NO: 2479 |
| DICER1 | NM_177438.1 | TCCAATTCCAGCATCACTGTGGAGAAAAGCTG TTTGTCTCCCCAGCATACTTTATCGCCTTCACTGCC | SEQ ID NO: 2480 |
| DKK1 | NM_012242.1 | TGACAACTACCAGCCGTACCCGTGCGCAGAGGACGAGGA GTGCGGCACTGATGAGTACTGCGCTAGTCCC | SEQ ID NO: 2481 |
| DLC1 | NM_006094.3 | GATTCAGACGAGGATGAGCCTTGTGCCATCAGTGGCAAATGG ACTTTCCAAAGGGACAGCAAGAGGTG | SEQ ID NO: 2482 |
| DPYD | NM_000110.2 | AGGACGCAAGGAGGGTTTGTCACTGGCAGACTCGAGACTGTAGGC ACTGCCATGGCCCCTGTGCTCAGTAAGGACTCGGCGGACATC | SEQ ID NO: 2483 |
| DR4 | NM_003844.1 | TGCACAGAGGGTGTGGGTTACACCAATGCTTCCAACAATTTGTTT GCTTGCCTCCCATGTACAGCTTGTAAATCAGATGAAGA | SEQ ID NO: 2484 |
| DR5 | NM_003842.2 | CTCTGAGACAGTGCTTCGATGACTTTGCAGACTTGGTGCCCTTTGA CTCCTGGGAGCCGCTCATGAGGAAGTTGGGCCTCATGG | SEQ ID NO: 2485 |
| DRG1 | NM_004147.3 | CCTGGATCTCCCAGGTATCATTGAAGGTGCCAAGGATGGG AAAGGTAGAGGTCGTCAAGTCATTGCA | SEQ ID NO: 2486 |
| DSP | NM_004415.1 | TGGCACTACTGCATGATTGACATAGAGAAGATCAGGGCCATGAC AATCGCCAAGCTGAAAACAATGCGGCAGG | SEQ ID NO: 2487 |
| DTYMK | NM_012145.1 | AAATCGCTGGGAACAAGTGCCGTTAATTAAGGAAAAGTTGAGC CAGGGCGTGACCCTCGTCGTGGACAGATACGCATT | SEQ ID NO: 2488 |
| DUSP1 | NM_004417.2 | AGACATCAGCTCCTGGTTCAACGAGGCCATTGACTTCATAGACTCC ATCAAGAATGCTGGAGGAAGGGTGTTTGTC | SEQ ID NO: 2489 |
| DUSP2 | NM_004418.2 | TATCCCTGTGGAGGACAACCAGATGGTGGAGATCAGTGCCT GGTTCCAGGAGGCCATAGGCTTCATTGACTGGGTG | SEQ ID NO: 2490 |
| DUT | NM_001948.2 | ACACATGGAGTGCTTCTGGAACTATCAGCCCACTTGACCAC CCAGTTTGTGGAAGCACAGGCAAGAG | SEQ ID NO: 2491 |
| DYRK1B | NM_004714.1 | AGCATGACACGGAGATGAAGTACTATATAGTACAC CTGAAGCGGCACTTCATGTTCCGGAACCACCTGTGCCTGGTATT | SEQ ID NO: 2492 |
| E2F1 | NM_005225.1 | ACTCCCTCTACCCTTGAGCAAGGGCAGGGTCCCTGAG CTGTTCTTCTGCCCCATACTGAAGGAACTGAGGCCTG | SEQ ID NO: 2493 |
| EDN1 endothelin | NM_001955.1 | TGCCACCTGGACATCATTTGGGTCAACACTCCCGAGCACGT TGTTCCGTATGGACTTGGAAGCCCTAGGTCCA | SEQ ID NO: 2494 |
| EFNA1 | NM_004428.2 | TACATCTCCAAACCCATCCACCAGCATGAAGACCGCTGCT TGAGGTTGAAGGTGACTGTCAGTGGCAA | SEQ ID NO: 2495 |
| EFNA3 | NM_004952.3 | ACTACATCTCCACGCCCACTCACAACCTGCACTGGAAGTGTC TGAGGATGAAGGTGTTCGTCTGCTG | SEQ ID NO: 2496 |

TABLE B-continued

| Gene | Locus Link | Sequence | Sequence ID Number |
|---|---|---|---|
| EFNB1 | NM_004429.3 | GGAGCCCGTATCCTGGAGCTCCCTCAACCCCAAGTTCCTGAG TGGGAAGGGCTTGGTGATCTATCC | SEQ ID NO: 2497 |
| EFNB2 | NM_004093.2 | TGACATTATCATCCCGCTAAGGACTGCGGACAGCGTCTTCT GCCCTCACTACGAGAAGGTCAGCGGGGACTAC | SEQ ID NO: 2498 |
| EFP | NM_005082.2 | TTGAACAGAGCCTGACCAAGAGGGATGAGTTCGAGTTTCTG GAGAAAGCATCAAAACTGCGAGGAATCTCAACA | SEQ ID NO: 2499 |
| EGFR | NM_005228.1 | TGTCGATGGACTTCCAGAACCACCTGGGCAGCTGCC AAAAGTGTGATCCAAGCTGTCCCAAT | SEQ ID NO: 2500 |
| EGLN1 | NM_022051.1 | TCAATGGCCGGACGAAAGCCATGGTTGCTTGTTATCCGGGCAAT GGAACGGGTTATGTACGTCATGTTGATAATCCAAA | SEQ ID NO: 2501 |
| EGLN3 | NM_022073.2 | GCTGGTCCTCTACTGCGGGAGCCGGCTGGGCAAATACTA CGTCAAGGAGAGGTCTAAGGCAATGGTGG | SEQ ID NO: 2502 |
| EGR1 | NM_001964.2 | GTCCCCGCTGCAGATCTCTGACCCGTTCGGATCCTT TCCTCACTCGCCCACCATGGACAACTACCCTAAGCTGGAG | SEQ ID NO: 2503 |
| EGR3 | NM_004430.2 | CCATGTGGATGAATGAGGTGTCTCCTTTCCATACCCAGT CTCACCTTCTCCCCACCCTACCTCACCTCTTCTCAGGCA | SEQ ID NO: 2504 |
| EI24 | NM_004879.2 | AAAGTGGTGAATGCCATTTGGTTTCAGGATATAGCTGACCT GGCATTTGAGGTATCAGGGAGGAAGCCTCAC | SEQ ID NO: 2505 |
| EIF4E | NM_001968.1 | GATCTAAGATGGCGACTGTCGAACCGGAAACCACCCCTACTCCTAA TCCCCCGACTACAGAAGAGGAGAAAACGGAATCTAA | SEQ ID NO: 2506 |
| EIF4EL3 | NM_004846.1 | AAGCCGCGGTTGAATGTGCCATGACCCTCTCCCTCTCTGG ATGGCACCATCATTGAAGCTGGCGTCA | SEQ ID NO: 2507 |
| ELAVL1 | NM_001419.2 | GACAGGAGGCCTCTATCCTGTCCCTCCACCCCACCCTCCACCTC AATCCCCTCCCATCTTCCCCAGACCTACCTCAC | SEQ ID NO: 2508 |
| EMP1 | NM_001423.1 | GCTAGTACTTTGATGCTCCCTTGATGGGGTCCAGAGAGCCTCCC TGCAGCCACCAGACTTGGCCTCCAGCTGTTC | SEQ ID NO: 2509 |
| EMR3 | NM_032571.2 | TGGCCTACCTCTTCACCATCATCAACAGCCTCCAAGGCTTCTT CATCTTCTTGGTCTACTGCCTCCTCA | SEQ ID NO: 2510 |
| EMS1 | NM_005231.2 | GGCAGTGTCACTGAGTCCTTGAAATCCTCCCCTGCCCCGCGG GTCTCTGGATTGGGACGCACAGTGCA | SEQ ID NO: 2511 |
| ENO1 | NM_001428.2 | CAAGGCCGTGAACGAGAAGTCCTGCAACTGCCTCCTGCT CAAAGTCAACCAGATTGGCTCCGTGACCG | SEQ ID NO: 2512 |
| EP300 | NM_001429.1 | AGCCCCAGCAACTACAGTCTGGGATGCCAAGGCCAGCCATGATGT CAGTGGCCCAGCATGGTCAACCTTTGAACA | SEQ ID NO: 2513 |
| EPAS1 | NM_001430.3 | AAGCCTTGGAGGGTTTCATTGCCGTGGTGACCCAAGATGG CGACATGATCTTTCTGTCAGAAAACATCAGCA | SEQ ID NO: 2514 |
| EpCAM | NM_002354.1 | GGGCCCTCAGAACAATGATGGGCTTTATGATCCTGACTGCGA TGAGAGCGGGCTCTTTAAGGCCAAGCAGTGCA | SEQ ID NO: 2515 |
| EPHA2 | NM_004431.2 | CGCCTGTTCACCAAGATTGACACCATTGCGCCCGATGAGATCA CCGTCAGCAGCGACTTCGAGGCACGCCAC | SEQ ID NO: 2516 |
| EPHB2 | NM_004442.4 | CAACCAGGCAGCTCCATCGGCAGTGTCCATCATGCA TCAGGTGAGCCGCACCGTGGACAGCATTAC | SEQ ID NO: 2517 |
| EPHB4 | NM_004444.3 | TGAACGGGTATCCTCCTTAGCCACGGGGCCCGTCCCA TTTGAGCCTGTCAATGTCACCACTGACCGAGAGGTACCT | SEQ ID NO: 2518 |
| EphB6 | NM_004445.1 | ACTGGTCCTCCATCGGCTCCCCAGGAGCTTTGGTTT GAGGTGCAAGGCTCAGCACTCATGCTACACTGG | SEQ ID NO: 2519 |
| EPM2A | NM_005670.2 | ACTGTGGCACTTAGGGGAGATGACATTTGCTTTGG GCAGAGGCAGCTAGCCAGGACACATTTCCACT | SEQ ID NO: 2520 |
| ErbB3 | NM_001982.1 | CGGTTATGTCATGCCAGATACACACCTCAAAGGTACTCCCTCCT CCCGGGAAGGCACCCTTTCTTCAGTGGGTCTCAGTTC | SEQ ID NO: 2521 |

TABLE B-continued

| Gene | Locus Link | Sequence | Sequence ID Number |
|---|---|---|---|
| ERCC1 | NM_001983.1 | GTCCAGGTGGATGTGAAAGATCCCCAGCAGGCCCTCAG AGGAGCTGGCTAAGATGTGTATCCTGGCCG | SEQ ID NO: 2522 |
| ERCC2 | NM_000400.2 | TGGCCTTCTTCACCAGCTACCAGTACATGGAGAGCACCG TGGCCTCCTGGTATGAGCAGGGGATCCTTG | SEQ ID NO: 2523 |
| EREG | NM_001432.1 | ATAACAAAGTGTAGCTCTGACATGAATGGCTATTGTTTGCATGGACAG TGCATCTATCTGGTGGACATGAGTCAAAACTACTGCAGGTGTG | SEQ ID NO: 2524 |
| ERK1 | Z11696.1 | ACGGATCACAGTGGAGGAAGCGCTGGCTCACCCCTACCTG GAGCAGTACTATGACCCGACGGATGAG | SEQ ID NO: 2525 |
| ERK2 | NM_002745.1 | AGTTCTTGACCCCTGGTCCTGTCTCCAGCCCGTC TTGGCTTATCCACTTTGACTCCTTTGAGCCGTTT | SEQ ID NO: 2526 |
| ESPL1 | NM_012291.1 | ACCCCCAGACCGGATCAGGCAAGCTGGCCCTCATGTCCCT TCACGGTGTTTGAGGAAGTCTGCCCTACA | SEQ ID NO: 2527 |
| EstR1 | NM_000125.1 | CGTGGTGCCCCTCTATGACCTGCTGCTGGAGATGCTGGACGCC CACCGCCTACATGCGCCCACTAGCC | SEQ ID NO: 2528 |
| ETV4 | NM_001986.1 | TCCAGTGCCTATGACCCCCCAGACAAATCGCCATCAAGTCC CCTGCCCCTGGTGCCCTTGGACAGT | SEQ ID NO: 2529 |
| F3 | NM_001993.2 | GTGAAGGATGTGAAGCAGACGTACTTGGCACGGGTCTTCTCC TACCCGGCAGGGAATGTGGAGAGCACCGGTT | SEQ ID NO: 2530 |
| FABP4 | NM_001442.1 | GCTTTGCCACCAGGAAAGTGGCTGGCATGGCCAAACC TAACATGATCATCAGTGTGAATGGGGATG | SEQ ID NO: 2531 |
| FAP | NM_004460.2 | CTGACCAGAACCACGGCTTATCCGGCCTGTCCACG AACCACTTATACACCCACATGACCCACTTCC | SEQ ID NO: 2532 |
| fas | NM_000043.1 | GGATTGCTCAACAACCATGCTGGGCATCTGGACCCTCCTAC CTCTGGTTCTTACGTCTGTTGCTAGATT ATCGTCCAAAAGTGTTAATGCC | SEQ ID NO: 2533 |
| fasI | NM_000639.1 | GCACTTTGGGATTCTTTCCATTATGATTCTTTGTTACAGGC ACCGAGAATGTTGTATTCAGTGAGGGTCTTCTTACATGC | SEQ ID NO: 2534 |
| FASN | NM_004104.4 | GCCTCTTCCTGTTCGACGGCTCGCCCACCTACG TACTGGCCTACACCCAGAGCTACCGGGCAAAGC | SEQ ID NO: 2535 |
| FBXO5 | NM_012177.2 | GGCTATTCCTCATTTTCTCTACAAAGTGGCCTCA GTGAACATGAAGAAGGTAGCCTCCTGGAGGAGAATTTC GGTGACAGTCTACAATCC | SEQ ID NO: 2536 |
| FBXW7 | NM_033632.1 | CCCCAGTTTCAACGAGACTTCATTTCATTGCTCCCTA AAGAGTTGGCACTCTATGTGCTTTCATTCCTGGAAC | SEQ ID NO: 2537 |
| FDXR | NM_004110.2 | GAGATGATTCAGTTACCGGGAGCCCGGCCCATTTT GGATCCTGTGGATTTCTTGGGTCTCCAGGACAAGAT | SEQ ID NO: 2538 |
| FES | NM_002005.2 | CTCTGCAGGCCTAGGTGCAGCTCCTCAGCGGCTCCA GCTCATATGCTGACAGCTCTTCACAGTCCTGG | SEQ ID NO: 2539 |
| FGF18 | NM_003862.1 | CGGTAGTCAAGTCCGGATCAAGGGCAAGGAGACGG AATTCTACCTGTGCATGAACCGCAAAGGCAAGC | SEQ ID NO: 2540 |
| FGF2 | NM_002006.2 | AGATGCAGGAGAGAGGAAGCCTTGCAAACCTGCAGAC TGCTTTTTGCCCAATATAGATTGGGTAAGGCTGCAAAAC | SEQ ID NO: 2541 |
| FGFR1 | NM_023109.1 | CACGGGACATTCACCACATCGACTACTATAAAAAGA CAACCAACGGCCGACTGCCTGTGAAGTGGATGGCACCC | SEQ ID NO: 2542 |
| FGFR2 isoform 1 | NM_000141.2 | GAGGGACTGTTGGCATGCAGTGCCCTCCCAGAGACCA ACGTTCAAGCAGTTGGTAGAAGACTTGGATCGAATTCTCACTC | SEQ ID NO: 2543 |
| FHIT | NM_002012.1 | CCAGTGGAGCGCTTCCATGACCTGCGTCCTG ATGAAGTGGCCGATTTGTTTCAGACGACCCAGAGAG | SEQ ID NO: 2544 |
| FIGF | NM_004469.2 | GGTTCCAGCTTTCTGTAGCTGTAAGCATTG GTGGCCACACCACCTCCTTACAAAAGCAACTAGAACCTGCGGC | SEQ ID NO: 2545 |
| FLJ12455 | NM_022078.1 | CCACCAGCATGAAGTTTCGGACAGACATG GCCTTTGTGAGGGGTTCCAGTTGTGCTTCAGACAGC | SEQ ID NO: 2546 |

TABLE B-continued

| Gene | Locus Link | Sequence | Sequence ID Number |
|---|---|---|---|
| FLJ20712 | AK000719.1 | GCCACACAAACATGCTCCTGCTCCTGGCGGAGGCAGAGC TGCTGGGAAAGACATTTCGGAAGTTTCCTGTGGC | SEQ ID NO: 2547 |
| FLT1 | NM_002019.1 | GGCTCCCGAATCTATCTTTGACAAAATCTACAGCACCAAGA GCGACGTGTGGTCTTACGGAGTATTGCTGTGGGA | SEQ ID NO: 2548 |
| FLT4 | NM_002020.1 | ACCAAGAAGCTGAGGACCTGTGGCTGAGCCCGCTGACCATG GAAGATCTTGTCTGCTACAGCTTCCAGG | SEQ ID NO: 2549 |
| FOS | NM_005252.2 | CGAGCCCTTTGATGACTTCTTGTTCCCAGCATC ATCCAGGCCCAGTGGCTCTGAGACAGCCCGCTCC | SEQ ID NO: 2550 |
| FOXO3A | NM_001455.1 | TGAAGTCCAGGACGATGATGCGCCTCTCTCGCCCATGCTCTACAGC AGCTCAGCCAGCCTGTCACCTTCAGTAAGCAAGCCGT | SEQ ID NO: 2551 |
| FPGS | NM_004957.3 | CAGCCCTGCCAGTTTGACTATGCCGTCTTCTGCCCTA ACCTGACAGAGGTGTCATCCACAGGCAAC | SEQ ID NO: 2552 |
| FRP1 | NM_003012.2 | TTGGTACCTGTGGGTTAGCATCAAGTTCTCCCCAGGGTAGA ATTCAATCAGAGCTCCAGTTTGCATTTGGATGTG | SEQ ID NO: 2553 |
| FST | NM_006350.2 | GTAAGTCGGATGAGCCTGTCTGTGCCAGTGACAATGCCACT TATGCCAGCGAGTGTGCCATGAAGGAAGCTG | SEQ ID NO: 2554 |
| Furin | NM_002569.1 | AAGTCCTCGATACGCACTATAGCACCGAGAATGACGTGGAGACCAT CCGGGCCAGCGTCTGCGCCCCCTGCCACGCCTCATGTGCCACATGCCAG | SEQ ID NO: 2555 |
| FUS | NM_004960.1 | GGATAATTCAGACAACAACACCATCTTTGTGCAA GGCCTGGGTGAGAATGTTACAATTGAGTCTGTGGCTGATTACTTCA | SEQ ID NO: 2556 |
| FUT1 | NM_000148.1 | CCGTGCTCATTGCTAACCACTGTCTGTCCCT GAACTCCCAGAACCACTACATCTGGCTTTGGGCAG | SEQ ID NO: 2557 |
| FUT3 | NM_000149.1 | CAGTTCGGTCCAACAGAGAAAGCAGGCAACCA CCATGTCATTTGAAAACAGTTTCATCGGGATATAATTCGCA | SEQ ID NO: 2558 |
| FUT6 | NM_000150.1 | CGTGTGTCTCAAGACGATCCCACTGTGTACCCTAAT GGGTCCCGCTTCCCAGACAGCACAGGGACC | SEQ ID NO: 2559 |
| FXYD5 | NM_014164.4 | AGAGCACCAAAGCAGCTCATCCCACTGATGACAC CACGACGCTCTCTGAGAGACCATCCCCAAGCAC | SEQ ID NO: 2560 |
| FYN | NM_002037.3 | GAAGCGCAGATCATGAAGAAGCTGAAGCACGACAAG CTGGTCCAGCTCTATGCAGTGGTGTCTGAGGAG | SEQ ID NO: 2561 |
| FZD1 | NM_003505.1 | GGTGCACCAGTTCTACCCTCTAGTGAAAGTGCAGTGTTCC GCTGAGCTCAAGTTCTTCCTGTGCTCCATGTACGC | SEQ ID NO: 2562 |
| FZD2 | NM_001466.2 | TGGATCCTCACCTGGTCGGTGCTGTGCTGCGCTTCCACCTTCTT CACTGTCACCACGTACTTGGTAGACATGCAGCGC | SEQ ID NO: 2563 |
| FZD6 | NM_003506.2 | AATGAGAGAGGTGAAAGCGGACGGAGCTAGCACC CCCAGGTTAAGAGAACAGGACTGTGGTGAACCT | SEQ ID NO: 2564 |
| G-Catenin | NM_002230.1 | TCAGCAGCAAGGGCATCATGGAGGAGGATGAG GCCTGCGGGCGCCAGTACACGCTCAAGAAAACCACC | SEQ ID NO: 2565 |
| G1P2 | NM_005101.1 | CAACGAATTCCAGGTGTCCCTGAGCAGCTCCATGTC GGTGTCAGAGCTGAAGGCGCAGATC | SEQ ID NO: 2566 |
| GADD45 | NM_001924.2 | GTGCTGGTGACGAATCCACATTCATCTCAATGGAAGGATCC TGCCTTAAGTCAACTTATTTGTTTTTGCCGGG | SEQ ID NO: 2567 |
| GADD45B | NM_015675.1 | ACCCTCGACAAGACCACACTTTGGGACTTGGGAGCTG GGGCTGAAGTTGCTCTGTACCCATGAACTCCCA | SEQ ID NO: 2568 |
| GADD45G | NM_006705.2 | CGCGCTGCAGATCCATTTTACGCTGATCCAGGCTTTC TGCTGCGAGAACGACATCGACATAGTGCG | SEQ ID NO: 2569 |
| GAGE4 | NM_001474.1 | GGAACAGGGTCACCCACAGACTGGGTGTGAGTGTGAAGA TGGTCCTGATGGGCAGGAGATGGACCCGCCAAATC | SEQ ID NO: 2570 |
| GBP1 | NM_002053.1 | TTGGGAAATATTTGGGCATTGGTCTGGCCAAGTCTACAAT GTCCCAATATCAAGGACAACCACCCTAGCTTCT | SEQ ID NO: 2571 |

TABLE B-continued

| Gene | Locus Link | Sequence | Sequence ID Number |
|---|---|---|---|
| GBP2 | NM_004120.2 | GCATGGGAACCATCAACCAGCAGGCCATGGACCAACTTCACTA TGTGACAGAGCTGACAGATCGAATCAAGGCAAACTCCTCA | SEQ ID NO: 2572 |
| GCLC | NM_001498.1 | CTGTTGCAGGAAGGCATTGATCATCTCCTGGCCC AGCATGTTGCTCATCTCTTTATTAGAGACCCACTGAC | SEQ ID NO: 2573 |
| GCLM | NM_002061.1 | TGTAGAATCAAACTCTTCATCATCAACTAGAAGTGCAGTTGACA TGGCCTGTTCAGTCCTTGGAGTTGCACAGCTGGATTCTGTG | SEQ ID NO: 2574 |
| GCNT1 | NM_001490.3 | TGGTGCTTGGAGCATAGAAGACTGCCCTTCACAAAG GAAATCCCTGATTATTGTTTGAAATGCTGAGGACGTTGC | SEQ ID NO: 2575 |
| GDF15 | NM_004864.1 | CGCTCCAGACCTATGATGACTTGTTAGCCAA AGACTGCCACTGCATATGAGCAGTCCTGGTCCTTCCACTGT | SEQ ID NO: 2576 |
| GIT1 | NM_014030.2 | GTGTATGACGAGGTGGATCGAAGAGAAAAT GATGCAGTGTGGCTGGCTACCCAAAACCACAGCACTCTGGT | SEQ ID NO: 2577 |
| GJA1 | NM_000165.2 | GTTCACTGGGGGTGTATGGGGTAGATGGG TGGAGAGGGAGGGGATAAGAGAGGTGCATGTTGGTATTT | SEQ ID NO: 2578 |
| GJB2 | NM_004004.3 | TGTCATGTACGACGGCTTCTCCATGCAGC GGCTGGTGAAGTGCAACGCCTGGCCTTGTCCCAACACTGTGGACT | SEQ ID NO: 2579 |
| GPX1 | NM_000581.2 | GCTTATGACCGACCCCAAGCTCATCACC TGGTCTCCGGTGTGTCGCAACGATGTTGCCTGGAACTTT | SEQ ID NO: 2580 |
| GPX2 | NM_002083.1 | CACACAGATCTCCTACTCCATCCAGTCCTGAGGAGCC TTAGGATGCAGCATGCCTTCAGGAGACACTGCTGGACC | SEQ ID NO: 2581 |
| Grb10 | NM_005311.2 | CTTCGCCTTTGCTGATTGCCTCTCC AAACGCCTGCCTGACGACTGCCTTGGAGCATGTGCGTTATGG | SEQ ID NO: 2582 |
| GRB14 | NM_004490.1 | TCCCACTGAAGCCCTTTCAGTTGCGGTTGAAGAAGG ACTCGCTTGGAGGAAAAAAGGATGTTTACGCCTGGGCACT | SEQ ID NO: 2583 |
| GRB2 | NM_002086.2 | GTCCATCAGTGCATGACGTTTAAGGCCACGTATAGTCC TAGCTGACGCCAATAATAAAAAACAAGAAACCAAGTGGGCT | SEQ ID NO: 2584 |
| GRB7 | NM_005310.1 | CCATCTGCATCCATCTTGTTTGGGCTCCCCA CCCTTGAGAAGTGCCTCAGATAATACCCTGGTGGCC | SEQ ID NO: 2585 |
| GRIK1 | NM_000830.2 | GTTGGGTGCATCTCTCGGGCGTCCGGCAGCGGCTGTATC TCGGCATGAATTAAGAAGCTAGGAAGATGGAGCACG | SEQ ID NO: 2586 |
| GRO1 | NM_001511.1 | CGAAAGATGCTGAACAGTGACAAATCCAACTGACCAGA AGGGAGGAGGAAGCTCACTGGTGGCTGTTCCTGA | SEQ ID NO: 2587 |
| GRP | NM_002091.1 | CTGGGTCTCATAGAAGCAAAGGAGAACAGAAACCACCAGCCACCTC AACCCAAGGCCTTGGGCAATCAGCAGCCTTCGTGG | SEQ ID NO: 2588 |
| GRPR | NM_005314.1 | ATGCTGCTGGCCATTCCAGAGGCCGTGTTTTCTGACCTC CATCCCTTCCATGAGGAAAGCACCAACCAGACCT | SEQ ID NO: 2589 |
| GSK3B | NM_002093.2 | GACAAGGACGGCAGCAAGGTGACAACAGTGGTGGCA ACTCCTGGGCAGGGTCCAGACAGGCCACAA | SEQ ID NO: 2590 |
| GSTA3 | NM_000847.3 | TCTCCAACTTCCCTCTGCTGAAGGCCCTGAAAACCAGA ATCAGCAACCTGCCCACGGTGAAGAAGT | SEQ ID NO: 2591 |
| GSTM1 | NM_000561.1 | AAGCTATGAGGAAAAGAAGTACACGATGGGGACGCTCCTGATTATGACAG AAGCCAGTGGCTGAATGAAAAATTCAAGCTGGGCC | SEQ ID NO: 2592 |
| GSTM3 | NM_000849.3 | CAATGCCATCTTGCGCTACATCGCTCGCAAGCACAACAT GTGTGGTGAGACTGAAGAAGAAAAGATTCGAGTGGAC | SEQ ID NO: 2593 |
| GSTp | NM_000852.2 | GAGACCCTGCTGTCCCAGAACCAGGGAGGCAAGACCTTCATTGTGGGAGA CCAGATCTCCTTCGCTGACTACAACC | SEQ ID NO: 2594 |
| GSTT1 | NM_000853.1 | CACCATCCCCACCCTGTCTTCCACAGCCGCCTGAAAGCC ACAATGAGAATGATGCACACTGAGGCC | SEQ ID NO: 2595 |
| H2AFZ | NM_002106.2 | CCGGAAAGGCCAAGACAAAGGCGGTTTCCCGCTCGCAGA GAGCCCGGCTTGCAGTTCCCAGTGGGCCGTATT | SEQ ID NO: 2596 |

TABLE B-continued

| Gene | Locus Link | Sequence | Sequence ID Number |
|---|---|---|---|
| HB-EGF | NM_001945.1 | GACTCCTTCGTCCCCAGTTGCCGTCTAGGATTGGGCCTCCCATAATT GCTTTGCCAAAATACCAGAGCCTTCAAGTGCCA | SEQ ID NO: 2597 |
| hCRA a | U78556.1 | TGACACCCTTACCTTCCTGAGAAATACCCCCTGGGAGCGCGGAAAGCAGAGCG GACAGGTCAGTGACTTCTATTTTTGACTCGTGTTTTT | SEQ ID NO: 2598 |
| HDAC1 | NM_004964.2 | CAAGTACCACAGCGATGACTACATTAAATTCTTGCGCTCC ATCCGTCCAGATAACATGTCGGAGTACAGCAAGC | SEQ ID NO: 2599 |
| HDAC2 | NM_001527.1 | GGTGGCTACACAATCCGTAATGTTGCTCGATGTTGGACA TATGAGACTGCAGTTGCCCTTGATTGTGAGATTCCCA | SEQ ID NO: 2600 |
| HDGF | NM_004494.1 | TCCTAGGCATTCTGGACCTCTGGGTTGGGATCAGGGG TAGGAATGGAAGGATGGAGCATCAACAGC | SEQ ID NO: 2601 |
| hENT1 | NM_004955.1 | AGCCGTGACTGTTGAGGTCAAGTCCAGCATCGCAG GCAGCAGCACCTGGGAACGTTACTT | SEQ ID NO: 2602 |
| Hepsin | NM_002151.1 | AGGCTGCTGGAGGTCATCTCCGTGTGTGATTGCCCCAGAGGCCGT TTCTTGGCCGCCATCTGCCAAGACTGTGGCCGCAGGAAG | SEQ ID NO: 2603 |
| HER2 | NM_004448.1 | CGGTGTGAGAAGTGCAGCAAGCCCTGTGCCCGAGTGTGCT ATGGTCTGGGCATGGAGCACTTGCGAGAGG | SEQ ID NO: 2604 |
| Herstatin | AF177761.2 | CACCCTGTCCTATCCTTCCTCAGACCCTCTTGGGACCTAGTC TCTGCCTTCTACTCTCTACCCCTGGCC | SEQ ID NO: 2605 |
| HES6 | NM_018645.3 | TTAGGGACCCTGCAGCTCTGGAGTGGGTGGAGGGAG GGAGCTACGGGCAGGAGGAAGAATTTTGTAG | SEQ ID NO: 2606 |
| HGF | M29145.1 | CCGAAATCCAGATGATGATGCTCATGGACCCTGGT GCTACACGGGAAATCCACTCATTCCTTGGG | SEQ ID NO: 2607 |
| HIF1A | NM_001530.1 | TGAACATAAAGTCTGCAACATGGAAGGTATTGCACTGCACA GGCCACATTCACGTATATGATACCAACAGTAACCAACCTCA | SEQ ID NO: 2608 |
| HK1 | NM_000188.1 | TACGCACAGAGGCAAGCAGCTAAGAGTCCGGGATCCCC AGCCTACTGCCTCTCCAGCACTTCTCTC | SEQ ID NO: 2609 |
| HLA-DPB1 | NM_002121.4 | TCCATGATGGTTCTGCAGGTTTCTGCGGCCCCCCGGACAGTGGCT CTGACGGCGTTACTGATGGTGCTGCTCA | SEQ ID NO: 2610 |
| HLA-DRA | NM_019111.3 | GACGATTTGCCAGCTTTGAGGCTCAAGGTGCATTGGCC AACATAGCTGTGGACAAAGCCAACCTGGA | SEQ ID NO: 2611 |
| HLA-DRB1 | NM_002124.1 | GCTTTCTCAGGACCTGGTTGCTACTGGTTCGG CAACTGCAGAAAATGTCCTCCCTTGTGGCTTCCT | SEQ ID NO: 2612 |
| HLA-G | NM_002127.2 | CCTGCGCGGCTACTACAACCAGAGCGAGGCCAGTTC TCACACCCTCCAGTGGATGATTGGCTGCGACCTG | SEQ ID NO: 2613 |
| HMGB1 | NM_002128.3 | TGGCCTGTCCATTGGTGATGTTGCGAAGAAACTGGG AGAGATGTGGAATAACACTGCTGCAGATGACAAGC | SEQ ID NO: 2614 |
| hMLH | NM_000249.2 | CTACTTCCAGCAACCCCAGAAAGAGACATCGGGAAGATTCTG ATGTGGAAATGGTGGAAGATGATTCCCGAAAG | SEQ ID NO: 2615 |
| HNRPAB | NM_004499.2 | CAAGGGAGCGACCAACTGATCGCACACATGCTTTGTTTGGAT ATGGAGTGAACACAATTATGTACCAAATTTAACTTGGCAAAC | SEQ ID NO: 2616 |
| HNRPD | NM_031370.2 | GCCAGTAAGAACGAGGAGGATGAAGGCCATTCAAACTCC TCCCCACGACACTCTGAAGCAGCGACG | SEQ ID NO: 2617 |
| HoxA1 | NM_005522.3 | AGTGACAGATGGACAATGCAAGAATGAACTCCTTCCTG GAATACCCCATACTTAGCAGTGGCGACTCGG | SEQ ID NO: 2618 |
| HoxA5 | NM_019102.2 | TCCCTTGTGTTCCTTCTGTGAAGAAGCCCTGTTCTCGTT GCCCTAATTCATCTTTTAATCATGAGCCTGTTTATTGCC | SEQ ID NO: 2619 |
| HOXB13 | NM_006361.2 | CGTGCCTTATGGTTACTTTGGAGGCGGGTACTACTCC TGCCGAGTGTCCCGGAGCTCGCTGAAACCCTGTG | SEQ ID NO: 2620 |
| HOXB7 | NM_004502.2 | CAGCCTCAAGTTCGGTTTTCGCTACCGGAGCCTT CCCAGAACAAACTTCTTGTGCGTTTGCTTCCAAC | SEQ ID NO: 2621 |

TABLE B-continued

| Gene | Locus Link | Sequence | Sequence ID Number |
|---|---|---|---|
| HRAS | NM_005343.2 | GGACGAATACGACCCCACTATAGAGGATTCCTACCG GAAGCAGGTGGTCATTGATGGGGAGACGTGC | SEQ ID NO: 2622 |
| HSBP1 | NM_001537.1 | GGAGATGGCCGAGACTGACCCCAAGACCGTGCAGG ACCTCACCTCGGTGGTGCAGACACTCCTGCAG | SEQ ID NO: 2623 |
| HSD17B1 | NM_000413.1 | CTGGACCGCACGGACATCCACACCTTCCACCGCTTCTACCA ATACCTCGCCCACAGCAAGCAAGTCTTTCGCGAGGCG | SEQ ID NO: 2624 |
| HSD17B2 | NM_002153.1 | GCTTTCCAAGTGGGGAATTAAAGTTGCTTCCATCCA ACCTGGAGGCTTCCTAACAAATATCGCAGGCA | SEQ ID NO: 2625 |
| HSPA1A | NM_005345.4 | CTGCTGCGACAGTCCACTACCTTTTTCGAGAGTGACTCCCGTT GTCCCAAGGCTTCCCAGAGCGAACCTG | SEQ ID NO: 2626 |
| HSPA1B | NM_005346.3 | GGTCCGCTTCGTCTTTCGAGAGTGACTCCCGCGGTC CCAAGGCTTTCCAGAGCGAACCTGTGC | SEQ ID NO: 2627 |
| HSPA4 | NM_002154.3 | TTCAGTGTGTCCAGTGCATCTTTAGTGGAGGTTCACAAG TCTGAGGAAAATGAGGAGCCAATGGAAACAGAT | SEQ ID NO: 2628 |
| HSPA5 | NM_005347.2 | GGCTAGTAGAACTGGATCCCAACACCAAACTCTTAATTAGACCT AGGCCTCAGCTGCACTGCCCCGAAAAGCATTTGGGCAGACC | SEQ ID NO: 2629 |
| HSPA8 | NM_006597.3 | CCTCCCTCTGGTGGTGCTTCCTCAGGGCCCACCATTGA AGAGGTTGATTAAGCCAACCAAGTGTAGATGTAGC | SEQ ID NO: 2630 |
| HSPB1 | NM_001540.2 | CCGACTGGAGGAGCATAAAAGCGCAGCCGAGCCCAGCGCCC CGCACTTTTCTGAGCAGACGTCCAGAGCAGAGTCAGCCAGCAT | SEQ ID NO: 2631 |
| HSPCA | NM_005348.2 | CAAAAGGCAGAGGCTGATAAGAACGACAAGTCTGTGAAG GATCTGGTCATCTTGCTTTATGAAACTGCGCT | SEQ ID NO: 2632 |
| HSPE1 | NM_002157.1 | GCAAGCAACAGTAGTCGCTGTTGGATCGGGTTCTAAAGGAA AGGGTGGAGAGATTCAACCAGTTAGCGTGAAAGTTGG | SEQ ID NO: 2633 |
| HSPG2 | NM_005529.2 | GAGTACGTGTGCCGAGTGTTGGGCAGCTCCGTGCCT CTAGAGGCCTCTGTCCTGGTCACCATTGAG | SEQ ID NO: 2634 |
| ICAM1 | NM_000201.1 | GCAGACAGTGACCATCTACAGCTTTCCGGCGCCCAACGTGAT TCTGACGAAGCCAGAGGTCTCAGAAG | SEQ ID NO: 2635 |
| ICAM2 | NM_000873.2 | GGTCATCCTGACACTGCAACCCACTTTGGTGGCTGT GGGCAAGTCCTTCACCATTGAGTGCA | SEQ ID NO: 2636 |
| ID1 | NM_002165.1 | AGAACCGCAAGGTGAGCAAGGTGGAGATTCTCCAGCAC GTCATCGACTACATCAGGGACCTTCAGTTGGA | SEQ ID NO: 2637 |
| ID2 | NM_002166.1 | AACGACTGCTACTCCAAGCTCAAGGAGCTGGTGCC CAGCATCCCCCAGAACAAGAAGGTGAGCAAGATGGAAATCC | SEQ ID NO: 2638 |
| ID3 | NM_002167.2 | CTTCACCAAATCCCTTCCTGGAGACTAAACCTGGTGCTCAGGA GCGAAGGACTGTGAACTTGTAGCCTGAAGAGCCAGAG | SEQ ID NO: 2639 |
| ID4 | NM_001546.2 | TGGCCTGGCTCTTAATTTGCTTTTGTTTTGCCCAGTATAGACTCGGA AGTAAGAGTTATAGCTAGTGGTCTTGCATGATTGCA | SEQ ID NO: 2640 |
| IFIT1 | NM_001548.1 | TGACAACCAAGCAAATGTGAGGAGTCTGGTGACCTGGGGCAAC TTTGCCTGGATGTATTACCACATGGGCAGACTG | SEQ ID NO: 2641 |
| IGF1 | NM_000618.1 | TCCGGAGCTGTGATCTAAGGAGGCTGGAGATGTATTGCGC ACCCCTCAAGCCTGCCAAGTCAGCTCGCTCTGTCCG | SEQ ID NO: 2642 |
| IGF1R | NM_000875.2 | GCATGGTAGCCGAAGATTTCACAGTCAAAATCGGAGATTTGGTA TGACGCGAGATATCTATGAGACAGACTATTACCGGAAA | SEQ ID NO: 2643 |
| IGF2 | NM_000612.2 | CCGTGCTTCCGGACAACTTCCCCAGATACCCCGTGGGCAAGT TCTTCCAATATGACACCTGGAAGCAGTCCA | SEQ ID NO: 2644 |
| IGFBP2 | NM_000597.1 | GTGGACAGCACCATGAACATGTTGGGCGGGGAGGCAGTG CTGGCCGGAAGCCCCTCAAGTCGGGTATGAAGG | SEQ ID NO: 2645 |
| IGFBP3 | NM_000598.1 | ACGCACCGGGTGTCTGATCCCAAGTTCCACCCCCTC CATTCAAAGATAATCATCATCAAGAAAGGGCA | SEQ ID NO: 2646 |

TABLE B-continued

| Gene | Locus Link | Sequence | Sequence ID Number |
|---|---|---|---|
| IGFBP5 | NM_000599.1 | TGGACAAGTACGGGATGAAGCTGCCAGGCATGGAGTA CGTTGACGGGGACTTTCAGTGCCACACCTTCG | SEQ ID NO: 2647 |
| IGFBP6 | NM_002178.1 | TGAACCGCAGAGACCAACAGAGGAATCCAGGCACCTCTAC CACGCCCTCCCAGCCCAATTCTGCGGGTGTCCAAGAC | SEQ ID NO: 2648 |
| IGFBP7 | NM_001553 | GGGTCACTATGGAGTTCAAAGGACAGAACTCCTGCCTGG TGACCGGGACAACCTGGCCATTCAGACCC | SEQ ID NO: 2649 |
| IHH | NM_002181.1 | AAGGACGAGGAGAACACAGGCGCCGACCGCCTCATGAC CCAGCGCTGCAAGGACCGCCTGAACTCGCTGGCTATCT | SEQ ID NO: 2650 |
| IL-8 | NM_000584.2 | AAGGAACCATCTCACTGTGTGTAAACATGACTTCCAAG CTGGCCGTGGCTCTCTTGGCAGCCTTCCTGAT | SEQ ID NO: 2651 |
| IL10 | NM_000572.1 | GGCGCTGTCATCGATTTCTTCCCTGTGAAAACAAGAGCAAGGCC GTGGAGCAGGTGAAGAATGCCTTTAATAAGCTCCA | SEQ ID NO: 2652 |
| IL1B | NM_000576.2 | AGCTGAGGAAGATGCTGGTTCCCTGCCCACAGACCT TCCAGGAGAATGACCTGAGCACCTTCTTTCC | SEQ ID NO: 2653 |
| IL6 | NM_000600.1 | CCTGAACCTTCCAAAGATGGCTGAAAAAGATGGATG CTTCCAATCTGGATTCAATGAGGAGACTTGCCTGGT | SEQ ID NO: 2654 |
| IL6ST | NM_002184.2 | GGCCTAATGTTCCAGATCCTTCAAAGAGTCATATTGCCCAGTGGTC ACCTCACACTCCTCCAAGGCACAATTTT | SEQ ID NO: 2655 |
| ILT-2 | NM_006669.1 | AGCCATCACTCTCAGTGCAGCCAGGTCCTATCGTGGC CCCTGAGGAGACCCTGACTCTGCAGT | SEQ ID NO: 2656 |
| IMP-1 | NM_006546.2 | GAAAGTGTTTGCGGAGCACAAGATCTCCTACAGCGGCCA GTTCTTGGTCAAATCCGGCTACGCCTTC | SEQ ID NO: 2657 |
| IMP2 | NM_006548.3 | CAATCTGATCCCAGGGTTGAACCTCAGCGCACTTGGCATCTTTT CAACAGGACTGTCCGTGCTATCTCCACCAGCAGGGCC | SEQ ID NO: 2658 |
| ING1L | NM_001564.1 | TGTTTCCAAGATCCTGCTGAAAGTGAACGAGCCTCAGA TAAAGCAAAGATGGATTCCAGCCAACCAGAAAGA | SEQ ID NO: 2659 |
| ING5 | NM_032329.4 | CCTACAGCAAGTGCAAGGAATACAGTGACGACAAAGTG CAGCTGGCCATGCAGACCTACGAGATG | SEQ ID NO: 2660 |
| INHA | NM_002191.2 | CCTCCCAGTTTCATCTTCCACTACTGTCATGGTGGTTGTGG GCTGCAGATCCCACCAAACCTGTCCCTTCCAGTCCCT | SEQ ID NO: 2661 |
| INHBA | NM_002192.1 | GTGCCCGAGCCATATAGCAGGCACGTCCGGGTCCTC ACTGTCCTTCCACTCAACAGTCATCAACCACTACCG | SEQ ID NO: 2662 |
| INHBB | NM_002193.1 | AGCCTCCAGGATACCAGCAAATGGATGCGGTGACAAATGGCA GCTTAGCTACAAATGCCTGTCAGTCGGAGA | SEQ ID NO: 2663 |
| IRS1 | NM_005544.1 | CCACAGCTCACCTTCTGTCAGGTGTCCATCCCAGCTCCAGC CAGCTCCCAGAGAGGAAGAGACTGGCACTGAGG | SEQ ID NO: 2664 |
| ITGA3 | NM_002204.1 | CCATGATCCTCACTCTGCTGGTGGACTATACACTCCA GACCTCGCTTAGCATGGTAAATCACCGGCTACAAAGCTTC | SEQ ID NO: 2665 |
| ITGA4 | NM_000885.2 | CAACGCTTCAGTGATCAATCCCGGGGCGATTTACAGATG CAGGATCGGAAAGAATCCCGGCCAGAC | SEQ ID NO: 2666 |
| ITGA5 | NM_002205.1 | AGGCCAGCCCTACATTATCAGAGCAAGAGCCGGATAGAGG ACAAGGCTCAGATCTTGCTGGACTGTGGAGAAGAC | SEQ ID NO: 2667 |
| ITGA6 | NM_000210.1 | CAGTGACAAACAGCCCTTCCAACCCAAGGAATCCCACA AAAGATGGCGATGACGCCCATGAGGCTAAAC | SEQ ID NO: 2668 |
| ITGA7 | NM_002206.1 | GATATGATTGGTCGCTGCTTTGTGCTCAGCCAGGACCTGGCCA TCCGGGATGAGTTGGATGGTGGGAATGGAAGTTCT | SEQ ID NO: 2669 |
| ITGAV | NM_002210.2 | ACTCGGACTGCACAAGCTATTTTTGATGACAGCTAT TTGGGTTATTCTGTGGCTGTCGGAGATTTCAATGGTGATGGCA | SEQ ID NO: 2670 |
| ITGB1 | NM_002211.2 | TCAGAATTGGATTTGGCTCATTTGTGGAAAAGACTGTGAT GCCTTACATTAGCACAACACCAGCTAAGCTCAGG | SEQ ID NO: 2671 |

TABLE B-continued

| Gene | Locus Link | Sequence | Sequence ID Number |
|---|---|---|---|
| ITGB3 | NM_000212.1 | ACCGGGAGCCCTACATGACCGAAAATACCTGCAACCGTTACT GCCGTGACGAGATTGAGTCAGTGAAAGAGCTTAAGG | SEQ ID NO: 2672 |
| ITGB4 | NM_000213.2 | CAAGGTGCCCTCAGTGGAGCTCACCAACCTGTAC CCGTATTGCGACTATGAGATGAAGGTGTGCGC | SEQ ID NO: 2673 |
| ITGB5 | NM_002213.3 | TCGTGAAAGATGACCAGGAGGCTGTGCTATGTTTCTACAAAA CCGCCAAGGACTGCGTCATGATGTTCACC | SEQ ID NO: 2674 |
| K-ras | NM_033360.2 | GTCAAAATGGGGAGGGACTAGGGCAGTTGGATAGCTCAA CAAGATACAATCTCACTCTGTGGTGGTCCTG | SEQ ID NO: 2675 |
| KCNH2 iso a/b | NM_000238.2 | GAGCGCAAAGTGGAAATCGCCTTCTACCGGAAAGATGGGAG CTGCTTCCTATGTCTGGTGGATGTGGTGCCCGTGAAGA | SEQ ID NO: 2676 |
| KCNH2 iso a/c | NM_172057.1 | TCCTGCTGCTGGTCATCTACACGGCTGTCTTCACACCCTACTCG GCTGCCTTCCTGCTGAAGGAGACGGAAGAAGG | SEQ ID NO: 2677 |
| KCNK4 | NM_016611.2 | CCTATCAGCCGCTGGTGTGGTTCTGGATCCTGCTCG GCCTGGCTTACTTCGCCTCAGTGCTCACCACCA | SEQ ID NO: 2678 |
| KDR | NM_002253.1 | GAGGACGAAGGCCTCTACACCTGCCAGGCATGCAGT GTTCTTGGCTGTGCAAAAGTGGAGGCATTTTT | SEQ ID NO: 2679 |
| Ki-67 | NM_002417.1 | CGGACTTTGGGTGCGACTTGACGAGCGGTGGTTCGACAAGTGGCC TTGCGGGCCGGATCGTCCCAGTGGAAGAGTTGTAA | SEQ ID NO: 2680 |
| KIAA0125 | NM_014792.2 | GTGTCCTGGTCCATGTGGTGCACGTGTCTCCACC TCCAAGGAGAGGCTCCTCAGTGTGCACCTCCC | SEQ ID NO: 2681 |
| KIF22 | NM_007317.1 | CTAAGGCACTTGCTGGAAGGGCAGAATGCCAGT GTGCTTGCCTATGGACCCACAGGAGCTGGGAAGA | SEQ ID NO: 2682 |
| KIF2C | NM_006845.2 | AATTCCTGCTCCAAAAGAAAGTCTTCGAAGCCGCTCCA CTCGCATGTCCACTGTCTCAGAGCTTCGCATCACG | SEQ ID NO: 2683 |
| KIFC1 | XM_371813.1 | CCACAGGGTTGAAGAACCAGAAGCCAGTTCCTGCTGT TCCTGTCCAGAAGTCTGGCACATCAGGTG | SEQ ID NO: 2684 |
| Kitlng | NM_000899.1 | GTCCCCGGGATGGATGTTTTGCCAAGTCATTGTTGGATAAGC GAGATGGTAGTACAATTGTCAGACAGCTTGACTGATC | SEQ ID NO: 2685 |
| KLF5 | NM_001730.3 | GTGCAACCGCAGCTTCTCGCGCTCTGACCACCTGGCCCTGCAT ATGAAGAGGCACCAGAACTGAGCACTGCCCG | SEQ ID NO: 2686 |
| KLF6 | NM_001300.4 | CACGAGACCGGCTACTTCTCGGCGCTGCCGTCTCT GGAGGAGTACTGGCAACAGACCTGCCTAGAGC | SEQ ID NO: 2687 |
| KLK10 | NM_002776.1 | GCCCAGAGGCTCCATCGTCCATCCTCTTCCTCCCCAGTCGGCTGAA CTCTCCCCTTGTCTGCACTGTTCAAACCTCTG | SEQ ID NO: 2688 |
| KLK6 | NM_002774.2 | GACGTGAGGGTCCTGATTCTCCCTGGTTTTACCCCAGCTCCAT CCTTGCATCACTGGGGAGGACGTGATGAGTGAGGA | SEQ ID NO: 2689 |
| KLRK1 | NM_007360.1 | TGAGAGCCAGGCTTCTTGTATGTCTCAAAATGCCA GCCTTCTGAAAGTATACAGCAAAGAGGACCAGGAT | SEQ ID NO: 2690 |
| KNTC2 | NM_006101.1 | ATGTGCCAGTGAGCTTGAGTCCTTGGAGAAACACAA GCACCTGCTAGAAAGTACTGTTAACCAGGGGCTCA | SEQ ID NO: 2691 |
| KRAS2 | NM_004985.3 | GAGACCAAGGTTGCAAGGCCAGGCCCTGTGTGAA CCTTTGAGCTTTCATAGAGAGTTTCACAGCATGGACTG | SEQ ID NO: 2692 |
| KRT19 | NM_002276.1 | TGAGCGGCAGAATCAGGAGTACCAGCGGCTCATG GACATCAAGTCGCGGCTGGAGCAGGAGATTGCCACCTACCGCA | SEQ ID NO: 2693 |
| KRT8 | NM_002273.1 | GGATGAAGCTTACATGAACAAGGTAGAGCTGGAGTCTCGCCTGGA AGGGCTGACCGACGAGATCAACTTCCTCAGGCAGCTATATG | SEQ ID NO: 2694 |
| LAMA3 | NM_000227.2 | CAGATGAGGCACATGGAGACCCAGGCCAAGGACCTGAGG AATCAGTTGCTCAACTACCGTTCTGCCATTTCAA | SEQ ID NO: 2695 |
| LAMB3 | NM_000228.1 | ACTGACCAAGCCTGAGACCTACTGCACCCAGTATGGCGA GTGGCAGATGAAATGCTGCAAGTGTGAC | SEQ ID NO: 2696 |

TABLE B-continued

| Gene | Locus Link | Sequence | Sequence ID Number |
|---|---|---|---|
| LAMC2 | NM_005562.1 | ACTCAAGCGGAAATTGAAGCAGATAGGTCTTATCAGCACAGTCTCC GCCTCCTGGATTCAGTGTCTCGGCTTCAGGGAGT | SEQ ID NO: 2697 |
| LAT | NM_014387.2 | GTGAACGTTCCGGAGAGCGGGGAGAGCGCAGAAGCG TCTCTGGATGGCAGCCGGGAGTATGTGAATGT | SEQ ID NO: 2698 |
| LCN2 | NM_005564.2 | CGCTGGGCAACATTAAGAGTTACCCTGGATTAACGAGTTACCTCGTCC GAGTGGTGAGCACCAACTACAACCAGCATGCT | SEQ ID NO: 2699 |
| LDLRAP1 | NM_015627.1 | CAGTGCCTCTCGCCTGTCGACTGGGACAAGCCTGACA GCAGCGGCACAGAGCAGGATGACCTCTTCA | SEQ ID NO: 2700 |
| LEF | NM_016269.2 | GATGACGGAAAGCATCCAGATGGAGGCCTCTACAACA AGGGACCCTCCTACTCGAGTTATTCCGGG | SEQ ID NO: 2701 |
| LGALS3 | NM_002306.1 | AGCGGAAAATGGCAGACAATTTTTCGCTCCATGAT GCGTTATCTGGGTCTGGAAACCCAAACCCTCAAG | SEQ ID NO: 2702 |
| LGMN | NM_001008530.1 | TTGGTGCCGTTCCTATAGATGATCCTGAAGATGGAGGCAAG CACTGGGTGGTGATCGTGGCAGGTTC | SEQ ID NO: 2703 |
| LILRB3 | NM_006864.1 | CACCTGGTCTGGGAAGATACCTGGAGGTTTTGATT GGGGTCTCGGTGGCCTTCGTCCTGCTGCTCTT | SEQ ID NO: 2704 |
| LMNB1 | NM_005573.1 | TGCAAACGCTGGTGTCACAGCCAGCCCCCCAA CTGACCTCATCTGGAAGAACCAGAACTCGTGGGG | SEQ ID NO: 2705 |
| LMYC | NM_012421.1 | CCCATCCAGAACACTGATTGCTGTCATTCAAGTGAAAGGG ATGGAGGTCAGAAAGGGTGCATAGAAAGCAG | SEQ ID NO: 2706 |
| LOX | NM_002317.3 | CCAATGGGAGAACAACGGGCAGGTGTTCAGCTTG CTGAGCCTGGGCTCACAGTACCAGCCTCAGCG | SEQ ID NO: 2707 |
| LOXL2 | NM_002318.1 | TCAGCGGGCTCTTAAACAACCAGCTGTCCCCGCAGTA AAGAAGCCTGCGTGGTCAACTCCTGTCTT | SEQ ID NO: 2708 |
| LRP5 | NM_002335.1 | CGACTATGACCCACTGGACAAGTTCATCTACTGGGTGGATGG GCGCCAGAACATCAAGCGAGCCAAG | SEQ ID NO: 2709 |
| LRP6 | NM_002336.1 | GGATGTAGCCATCTCTGCCTCTATAGACCTCAGGGCCTTCG CTGTGCTTGCCCTATTGGCTTTGAACT | SEQ ID NO: 2710 |
| LY6D | NM_003695.2 | AATGCTGATGACTTGGAGCAGGCCCCACAGACCCCACAGAGG ATGAAGCCACCCCACAGAGGATGCAG | SEQ ID NO: 2711 |
| MAD | NM_002357.1 | TGGTTCTGATTAGGTAACGTATTGGACCTGCCCACAACT CCCTTGCACGTAAACTTCAGTGTCCCACCTTGACC | SEQ ID NO: 2712 |
| MAD1L1 | NM_003550.1 | AGAAGCTGTCCCTGCAAGAGCAGGATGCAGCGATTGT GAAGAACATGAAGTCTGAGCTGGTACGGCT | SEQ ID NO: 2713 |
| MAD2L1 | NM_002358.2 | CCGGGAGCAGGGAATCACCCTGCGCGGGAGCGCCGAAATCGT GGCCGAGTTCTTCTCATTCGGCATCAACAGCAT | SEQ ID NO: 2714 |
| MADH2 | NM_005901.2 | GCTGCCTTTGGTAAGAACATGTCGTCCATCTTGCCAT TCACGCCGCCAGTTGTGAAGAGACTGCTGGGAT | SEQ ID NO: 2715 |
| MADH4 | NM_005359.3 | GGACATTACTGGCCTGTTCACAATGAGCTTGCATTCCAGCCTCCC ATTTCCAATCATCCTGCTCCTGAGTATTGGT | SEQ ID NO: 2716 |
| MADH7 | NM_005904.1 | TCCATCAAGGCTTTCGACTACGAGAAGGCGTACAGCCTGCAGCGGC CCAATGACCACGAGTTTATGCAGCAG | SEQ ID NO: 2717 |
| MAP2 | NM_031846.1 | CGGACCACCAGGTCAGAGCCAATTCGCAGAGCAGGGAAGAG TGGTACCTCAACACCCACTACCCCTG | SEQ ID NO: 2718 |
| MAP2K1 | NM_002755.2 | GCCTTTCTTACCCAGAAGCAGAAGGTGGGAGAACTGAAGGATGACG ACTTTGAGAAGATCAGTGAGCTGGGGCTG | SEQ ID NO: 2719 |
| MAP3K1 | XM_042066.8 | GGTTGGCATCAAAAGGAACTGGTGCAGGAGAGTTTCAGG GACAATTACTGGGGACAATTGCATTTATGGCA | SEQ ID NO: 2720 |
| MAPK14 | NM_139012.1 | TGAGTGGAAAAGCCTGACCTATGATGAAGTCATCAGCTTTGTGCC ACCACCCCTTGACCAAGAAGAGATGGAGTCC | SEQ ID NO: 2721 |

TABLE B-continued

| Gene | Locus Link | Sequence | Sequence ID Number |
|---|---|---|---|
| Maspin | NM_002639.1 | CAGATGGCCACTTTGAGAACATTTTAGCTGACAACAGTGTGA ACGACCAGACCAAAATCCTTGTGGTTAATGCTGCC | SEQ ID NO: 2722 |
| MAX | NM_002382.3 | CAAACGGGCTCATCATAATGCACTGGAACGAAAACGTAGG GACCACATCAAAGACAGCTTTCACAGTTTGCGGGA | SEQ ID NO: 2723 |
| MCM2 | NM_004526.1 | GACTTTTGCCCGCTACCTTTCATTCCGGCGTGACAACAATGA GCTGTTGCTCTTCATACTGAAGCAGTTAGTGGC | SEQ ID NO: 2724 |
| MCM3 | NM_002388.2 | GGAGAACAATCCCCTTGAGACAGAATATGGCCTTTCTGTCTA CAAGGATCACCAGACCATCACCATCCAGGAGAT | SEQ ID NO: 2725 |
| MCM6 | NM_005915.2 | TGATGGTCCTATGTGTCACATTCATCACAGGTTTCATACCAAC ACAGGCTTCAGCACTTCCTTTGGTGTGTTTCCTGTCCCA | SEQ ID NO: 2726 |
| MCP1 | NM_002982.1 | CGCTCAGCCAGATGCAATCAATGCCCCAGTCACCTGCTGT TATAACTTCACCAATAGGAAGATCTCAGTGC | SEQ ID NO: 2727 |
| MDK | NM_002391.2 | GGAGCCGACTGCAAGTACAAGTTTGAGAACTGG GGTGCGTGTGATGGGGGCACAGGCACCAAAGTC | SEQ ID NO: 2728 |
| MDM2 | NM_002392.1 | CTACAGGGACGCCATCGAATCCGGATCTTGATGCTGG TGTAAGTGAACATTCAGGTGATTGGTTGGAT | SEQ ID NO: 2729 |
| MGAT5 | NM_002410.2 | GGAGTCGAAGGTGGACAATCTTGTTGTCAATGGCACCGGAA CAAACTCAACCAACTCCACTACAGCTGTTCCCA | SEQ ID NO: 2730 |
| MGMT | NM_002412.1 | GTGAAATGAAACGCACCACACTGGACAGCCCTTTGGGG AAGCTGGAGCTGTCTGGTTGTGAGCAGGGTC | SEQ ID NO: 2731 |
| mGST1 | NM_020300.2 | ACGGATCTACCACACCATTGCATATTTGACACCCCTTCCC AGCCAAATAGAGCTTTGAGTTTTTTTGTTGGATATGGA | SEQ ID NO: 2732 |
| MMP1 | NM_002421.2 | GGGAGATCATCGGGACAACTCTCCTTTTGATGGACCTGGAGG AAATCTTGCTCATGCTTTTCAACCAGGCCC | SEQ ID NO: 2733 |
| MMP12 | NM_002426.1 | CCAACGCTTGCCAAATCCTGACAATTCAGAACCAGCT CTCTGTGACCCCAATTTGAGTTTTGATGCTGTCACTACCGT | SEQ ID NO: 2734 |
| MMP2 | NM_004530.1 | CCATGATGGAGAGGCAGACATCATGATCAACTTTGG CCGCTGGGAGCATGGCGATGGATACCCCTTTGACGGTAAGGACGGACTCC | SEQ ID NO: 2735 |
| MMP7 | NM_002423.2 | GGATGGTAGCAGTCTAGGGATTAACTTCCTGTATGC TGCAACTCATGAACTTGGCCATTCTTTGGGTATGGGACATTCC | SEQ ID NO: 2736 |
| MMP9 | NM_004994.1 | GAGAACCAATCTCACCGACAGGCAGCTGGCAGAGGAA TACCTGTACCGCTATGGTTACACTCGGGTG | SEQ ID NO: 2737 |
| MRP1 | NM_004996.2 | TCATGGTGCCCGTCAATGCTGTGATGGCGATGAAGACCA AGACGTATCAGGTGGCCCACATGAAGAGCAAAGACAATCG | SEQ ID NO: 2738 |
| MRP2 | NM_000392.1 | AGGGGATGACTTGGACACATCTGCCATTCGACATG ACTGCAATTTTGACAAAGCCATGCAGTTTT | SEQ ID NO: 2739 |
| MRP3 | NM_003786.2 | TCATCCTGGCGATCTACTTCCTCTGGCAGAACCTAGGTCCCTCTGTC CTGGCTGGAGTCGCTTTCATGGTCTTGCTGATTCCACTCAACGG | SEQ ID NO: 2740 |
| MRP4 | NM_005845.1 | AGCGCCTGGAATCTACAACTCGGAGTCCAGTGTTT TCCCACTTGTCATCTTCTCTCCAGGGGCTCT | SEQ ID NO: 2741 |
| MRPL40 | NM_003776.2 | ACTTGCAGGCTGCTATCCTTAACATGCTGCCCCTGAG AGTAGGAATGACCAGGGTTCAAGTCTGCT | SEQ ID NO: 2742 |
| MSH2 | NM_000251.1 | GATGCAGAATTGAGGCAGACTTTACAAGAAGATTTACT TCGTCGATTCCCAGATCTTAACCGACTTGCCAAGA | SEQ ID NO: 2743 |
| MSH3 | NM_002439.1 | TGATTACCATCATGGCTCAGATTGGCTCCTATGTTCC TGCAGAAGAAGCGACAATTGGGATTGTGGATGGCATTTTCACAAG | SEQ ID NO: 2744 |
| MSH6 | NM_000179.1 | TCTATTGGGGGATTGGTAGGAACCGTTACCAGCTG GAAATTCCTGAGAATTTCACCACTCGCAATTTG | SEQ ID NO: 2745 |
| MT3 | NM_005954.1 | GTGTGAGAAGTGTGCCAAGGACTGTGTGTGCAAA GGCGGAGAGGCAGCTGAGGCAGAAGCAGAGAAGTGCAG | SEQ ID NO: 2746 |

TABLE B-continued

| Gene | Locus Link | Sequence | Sequence ID Number |
|---|---|---|---|
| MTA1 | NM_004689.2 | CCGCCCTCACCTGAAGAGAAACGCGCTCCTTGGCGGAC ACTGGGGGAGGAGAGGAAGAAGCGCGGCTAACTTATTCC | SEQ ID NO: 2747 |
| MUC1 | NM_002456.1 | GGCCAGGATCTGTGGTGGTACAATTGACTCTGGC CTTCCGAGAAGGTACCATCAATGTCCACGACGTGGAG | SEQ ID NO: 2748 |
| MUC2 | NM_002457.1 | CTATGAGCCATGTGGGAACCGGAGCTTCGAGACCTGC AGGACCATCAACGGCATCCACTCCAACAT | SEQ ID NO: 2749 |
| MUC5B | XM_039877.11 | TGCCCTTGCACTGTCCTAACGGCTCAGCCATCCT GCACACCTACACCCACGTGGATGAGTGTGGCTG | SEQ ID NO: 2750 |
| MUTYH | NM_012222.1 | GTACGACCAAGAGAAACGGGACCTACCATGGAGAAGA CGGGCAGAAGATGAGATGGACCTGGACAGG | SEQ ID NO: 2751 |
| MVP | NM_017458.1 | ACGAGAACGAGGGCATCTATGTGCAGGATGTCAAGACCGGAAA GGTGCGCGCTGTGATTGGAAGCACCTACATGC | SEQ ID NO: 2752 |
| MX1 | NM_002462.2 | GAAGGAATGGGAATCAGTCATGAGCTAATCACCCTGGAGAT CAGCTCCCGAGATGTCCCGGATCTGACTCTAATAGAC | SEQ ID NO: 2753 |
| MXD4 | NM_006454.2 | AGAAACTGGAGGAGCAGGACCGCCGGGCACTGAGCATCA AGGAGCAGCTGCAGCAGGAGCATCGTTTCCTGAAG | SEQ ID NO: 2754 |
| MYBL2 | NM_002466.1 | GCCGAGATCGCCAAGATGTTGCCAGGGAGGACAGACAA TGCTGTGAAGAATCACTGGAACTCTACCATCAAAAG | SEQ ID NO: 2755 |
| MYH11 | NM_002474.1 | CGGTACTTCTGAGGGCTAATATATACGTACTCTGGCCTCT TCTGCGTGGTGGTCAACCCCTATAAACACCTGCCCATCTACTCGG | SEQ ID NO: 2756 |
| MYLK | NM_053025.1 | TGACGGAGCGTGAGTGCATCAAGTACATGCGGCAGATC TCGGAGGGAGTGGAGTACATCCACAAGCAGGGCAT | SEQ ID NO: 2757 |
| NAD2 | NM_000015.1 | TAACTGACATTCTTGAGCACCAGATCCGGGCTGTTCCCTTTG AGAACCTTAACATGCATTGTGGGCAAGCCAT | SEQ ID NO: 2758 |
| NAV2 | NM_182964.3 | CTCTCCCAGCACAGCTTGAACCTCACTGAGTCAACCA GCCTGGACATGTTGCTGGATGACACTGGTG | SEQ ID NO: 2759 |
| NCAM1 | NM_000615.1 | TAGTTCCCAGCTGACCATCAAAAAGGTGGATAAGAACGACGAG GCTGAGTACATCTGCATTGCTGAGAACAAGGCTG | SEQ ID NO: 2760 |
| NDE1 | NM_017668.1 | CTACTGCGGAAAGTCGGGGCACTGGAGTCCAAACTCGCT TCCTGCCGGAACCTCGTGTACGATCAGTCC | SEQ ID NO: 2761 |
| NDRG1 | NM_006096.2 | AGGGCAACATTCCACAGCTGCCCTGGCTGTGATGAGTG TCCTTGCAGGGGCCGGAGTAGGAGCACTG | SEQ ID NO: 2762 |
| NDUFS3 | NM_004551.1 | TATCCATCCTGATGGCGTCATCCCAGTGCTGACTTTCCTCAG GGATCACACCAATGCACAGTTCAA | SEQ ID NO: 2763 |
| NEDD8 | NM_006156.1 | TGCTGGCTACTGGGTGTTAGTTTGCAGTCCTGTGTG CTTCCCTCTCTTATGACTGTGTCCCTGGTTGTC | SEQ ID NO: 2764 |
| NEK2 | NM_002497.1 | GTGAGGCAGCGCGACTCTGGCGACTGGCCGGCCATGCCTTCCC GGGCTGAGGACTATGAAGTGTTGTACACCATTGGCA | SEQ ID NO: 2765 |
| NF2 | NM_000268.2 | ACTCCAGAGCTGACCTCCACCGCCCAGCCTGGGAAG TCATTGTAGGGAGTGAGACACTGAAGCCCTGA | SEQ ID NO: 2766 |
| NFKBp50 | NM_003998.1 | CAGACCAAGGAGATGGACCTCAGCGTGGTGCGGCTCATGTT TACAGCTTTTCTTCCGGATAGCACTGGCAGCT | SEQ ID NO: 2767 |
| NFKBp65 | NM_021975.1 | CTGCCGGGATGGCTTCTATGAGGCTGAGCTCTGC CCGGACCGCTGCATCCACAGTTTCCAGAACCTGG | SEQ ID NO: 2768 |
| NISCH | NM_007184.1 | CCAAGGAATCATGTTCGTTCAGGAGGAGGCCCTGGCCA GCAGCCTCTCGTCCACTGACAGTCTGACTCCCGAGCACCA | SEQ ID NO: 2769 |
| Nkd-1 | NM_033119.3 | GAGAGAGTGAGCGAACCCTGCCCAGGCTCCAAGAAGC AGCTGAAGTTTGAAGAGCTCCAGTGCGACG | SEQ ID NO: 2770 |
| NMB | NM_021077.1 | GGCTGCTGGTACAAATACTGCAGAAATGACACCAA TAATAGGGGCAGACACAACAGCGTGGCTTAGATTG | SEQ ID NO: 2771 |

TABLE B-continued

| Gene | Locus Link | Sequence | Sequence ID Number |
|---|---|---|---|
| NMBR | NM_002511.1 | TGATCCATCTCTAGGCCACATGATTGTCACCTTAGTTGCCCGGG TTCTCAGTTTTGGCAATTCTTGTGTCAACCCATTTGCTC | SEQ ID NO: 2772 |
| NME1 | NM_000269.1 | CCAACCCTGCAGACTCCAAGCCTGGGACCATCCGTGG AGACTTCTGCATACAAGTTGGCAGGAACATTATACAT | SEQ ID NO: 2773 |
| NOS3 | NM_000603.2 | ATCTCCGCCTCGCTCATGGGCACGGTGATGGCGAAGC GAGTGAAGGCGACAATCCTGTATGGCTCCGA | SEQ ID NO: 2774 |
| NOTCH1 | NM_017617.2 | CGGGTCCACCAGTTTGAATGGTCAATGCGAGTGGCTGT CCCGGCTGCAGAGCGGCATGGTGCCGAACCAATACAAC | SEQ ID NO: 2775 |
| NOTCH2 | NM_024408.2 | CACTTCCCTGCTGGGATTATATCAACAACCAGTG TGATGAGCTGTGCAACACGGTCGAGTGCCTGTTTGACAACT | SEQ ID NO: 2776 |
| NPM1 | NM_002520.2 | AATGTTGTCCAGGTTCTATTGCCAAGAATGTGTTGTCCAAA ATGCCTGTTTAGTTTTTAAAGATGGAACTCCACCCTTTGCTTG | SEQ ID NO: 2777 |
| NR4A1 | NM_002135.2 | CACAGCTTGCTTGTCGATGTCCCTGCCTTCGCCTG CCTCTCTGCCCTTGTCCTCATCACCGACCGGCAT | SEQ ID NO: 2778 |
| NRG1 | NM_013957.1 | CGAGACTCTCCTCATAGTGAAAGGTATGTGTCAGCCATGACCAC CCCGGCTCGTATGTCACCTGTAGATTTCCACACGCCAAG | SEQ ID NO: 2779 |
| NRP1 | NM_003873.1 | CAGCTCTCTCCACGCGATTCATCAGGATCTACCCCGAGAGAGCCACT CATGGCGGACTGGGGCTCAGAATGGAGCTGCTGGG | SEQ ID NO: 2780 |
| NRP2 | NM_003872.1 | CTACAGCCTAAACGGCAAGGACTGGGAATACATTCA GGACCCCAGGACCCAGCAGCCAAAGCTGTTCGAAGGGAAC | SEQ ID NO: 2781 |
| NTN1 | NM_004822.1 | AGAAGGACTATGCCGTCCAGATCCACATCCTGAAGG CGGACAAGGCGGGGACTGGTGGAAGTTCACGG | SEQ ID NO: 2782 |
| NUFIP1 | NM_012345.1 | GCTTCCACATCGTGGTATTGGAGACAGTCTTCTGATAGGTTTCCT CGGCATCAGAAGTCCTTCAACCCTGCAGTT | SEQ ID NO: 2783 |
| ODC1 | NM_002539.1 | AGAGATCACCGGCGTAATCAACCCAGCGTTGGACAAATACTTTC CGTCAGACTCTGGAGTGAGAATCATAGCTGAGCCCG | SEQ ID NO: 2784 |
| OPN, osteopontin | NM_000582.1 | CAACCGAAGTTTTCACTCCAGTTGTCCCCACAGTAGACACAT ATGATGGCCGAGGTGATAGTGTGGTTTATGGACTGAGG | SEQ ID NO: 2785 |
| ORC1L | NM_004153.2 | TCCTTGACCATACCGGAGGGTGCATGTACATCTCCGG TGTCCCTGGGACAGGGAAGACTGCCACTG | SEQ ID NO: 2786 |
| OSM | NM_020530.3 | GTTTCTGAAGGGGAGGTCACAGCCTGAGCTGGC CTCCTATGCCTCATCATGTCCCAAACCAGACACCT | SEQ ID NO: 2787 |
| OSMR | NM_003999.1 | GCTCATCATGGTCATGTGCTACTTGAAAAGTCAGTGGATCAA GGAGACCTGTTATCCTGACATCCCTGACCCTTACA | SEQ ID NO: 2788 |
| P14ARF | S78535.1 | CCCTCGTGCTGATGCTACTGAGGAGCCAGCGTCTAGGGCAGCAG CCGCTTCCTAGAAGACCAGGTCATGATG | SEQ ID NO: 2789 |
| p16-INK4 | L27211.1 | GCGGAAGGTCCCTCAGACATCCCCGATTGAAAGAACCAGAGA GGCTCTGAGAAACCTCGGGAAACTTAGATCATCA | SEQ ID NO: 2790 |
| p21 | NM_000389.1 | TGGAGACTCTCAGGGTCGAAAACGGCGGCAGA CCAGCATGACAGATTTCTACCACTCCAAACGCC | SEQ ID NO: 2791 |
| p27 | NM_004064.1 | CGGTGGACCACGAAGAGTTAACCCGGGACTT GGAGAAGCACTGCAGAGACATGGAAGAGGCGAGCC | SEQ ID NO: 2792 |
| P53 | NM_000546.2 | CTTTGAACCCTTGCTTGCAATAGGTGTGCGTC AGAAGCACCCAGGACTTCCATTTGCTTTGTCCCGGG | SEQ ID NO: 2793 |
| p53R2 | AB036063.1 | CCCAGCTAGTGTTCCTCAGAACAAAGATTGGAAAAAGCTGGCCGAG AACCATTTATACATAGAGGAAGGGCTTACGG | SEQ ID NO: 2794 |
| PADI4 | NM_012387.1 | AGCAGTGGCTTGCTTTCTTCCTGTGATGTCCCA GTTTCCCACTCTGAAGATCCCAACATGGTCCTAGCA | SEQ ID NO: 2795 |
| PAI1 | NM_000602.1 | CCGCAACGTGGTTTTCTCACCCTATGGGGTGGCCTCG GTGTTGGCCATGCTCCAGCTGACAACAGGAGGAGAAACCCAGCA | SEQ ID NO: 2796 |

TABLE B-continued

| Gene | Locus Link | Sequence | Sequence ID Number |
|---|---|---|---|
| Pak1 | NM_002576.3 | GAGCTGTGGGTTGTTATGGAATACTTGGCTGGAGGCT CCTTGACAGATGTGGTGACAGAAACTTGCATGG | SEQ ID NO: 2797 |
| PARC | NM_015089.1 | GGAGCTGACCTGCTTCCTACATCGCCTGGCC TCGATGCATAAGGACTATGCTGTGGTGCTCTGCT | SEQ ID NO: 2798 |
| PCAF | NM_003884.3 | AGGTGGCTGTGTTACTGCAACGTGCCACAGTTCTGC GACAGTCTACCTCGGTACGAAACCACACAGGTG | SEQ ID NO: 2799 |
| PCNA | NM_002592.1 | GAAGGTGTTGGAGGCACTCAAGGACCTCATCAACAGGCCT GCTGGGATATTAGCTCCAGCGGTGTAAACC | SEQ ID NO: 2800 |
| PDGFA | NM_002607.2 | TTGTTGGTGTGCCCTGGTGCCGTGGTGGCGGTCACT CCCTCTGCTGCCAGTGTTTGGACAGAACCCA | SEQ ID NO: 2801 |
| PDGFB | NM_002608.1 | ACTGAAGGAGACCCTTGGAGCCTAGGGGCATC GGCAGGAGAGTGTGTGGGCAGGGTTATTTA | SEQ ID NO: 2802 |
| PDGFC | NM_016205.1 | AGTTACTAAAAAATACCACGAGGTCCTTCAGTTGAGACCAAAGA CCGGTGTCAGGGGATTGCACAAATCACTCACCGAC | SEQ ID NO: 2803 |
| PDGFD | NM_025208.2 | TATCGAGGCAGGTCATACCATGACCGGAAGTCAAAAGTTG ACCTGGATAGGCTCAATGATGATGCCAAGCGTTA | SEQ ID NO: 2804 |
| PDGFRa | NM_006206.2 | GGGAGTTTCCAAGAGATGGACTAGTGCTTGGTC GGGTCTTGGGGTCTGGAGCGTTTGGGAAGGTGGTTGAAG | SEQ ID NO: 2805 |
| PDGFRb | NM_002609.2 | CCAGCTCTCCTTCCAGCTACAGATCAATGTCC CTGTCCGAGTGCTGGAGCTAAGTGAGAGCCACCC | SEQ ID NO: 2806 |
| PFN1 | NM_005022.2 | GGAAAACGTTCGTCAACATCACGCCAGCTGAGGTG GGTGTCCTGGTTGGCAAAGACCGGTCAAGTTTT | SEQ ID NO: 2807 |
| PFN2 | NM_053024.1 | TCTATACGTCGATGGTGACTGCACAATGGACATCCGGACAAAG AGTCAAGGTGGGGAGCCAACATACAATGTGGCTGTCGGC | SEQ ID NO: 2808 |
| PGK1 | NM_000291.1 | AGAGCCAGTTGCTGTAGAACTCAAATCTCTGCTGGGC AAGGATGTTCTGTTCTTGAAGGACTGTGTAGGCCCAG | SEQ ID NO: 2809 |
| PI3K | NM_002646.2 | TGCTACCTGGACAGCCCGTTGGTGCGCTTCCTCCTGAAACGAGCT GTGTCTGACTTGAGAGTGACTCACTACTTCTTCTGGTTACTGAAGGACGGCCT | SEQ ID NO: 2810 |
| PI3KC2A | NM_002645.1 | ATACCAATCACCGCACAAACCCAGGCTATTTGTTAAG TCCAGTCACAGCGCAAAGAAACATATGCGGAGAAAATGCTAGTGTG | SEQ ID NO: 2811 |
| PIK3CA | NM_006218.1 | GTGATTGAAGAGCATGCCAATTGGTCT GTATCCCGAGAAGCAGGATTAGCTATTCCCACGCAGGAC | SEQ ID NO: 2812 |
| PIM1 | NM_002648.2 | CTGCTCAAGGACACCGTCTACACGGACTT CGATGGGACCCGAGTGTATAGCCCTCAGAGTGGATCC | SEQ ID NO: 2813 |
| Pin1 | NM_006221.1 | GATCAACGGCTACATCCAGAAGATCAAGT CGGGAGAGGAGGACTTTGAGTCTCTGGCCTCACAGTTCA | SEQ ID NO: 2814 |
| PKD1 | NM_000296.2 | CAGCACCAGCGATTACGACGTTGGCTGGG AGAGTCCTCACAATGGCTCGGGGACGTGGGCCTATTCAG | SEQ ID NO: 2815 |
| PKR2 | NM_002654.3 | CCGCCTGGACATTGATTCACCACCCATCAC AGCCCGGAACACTGGCATCATCTGTACCATTGGCCCAG | SEQ ID NO: 2816 |
| PLA2G2A | NM_000300.2 | GCATCCCTCACCCATCCTAGAGGCCAGGCAGG AGCCCTTCTATACCCACCCAGAATGAGACATCCAGCAGATTTCCAGC | SEQ ID NO: 2817 |
| PLAUR | NM_002659.1 | CCCATGGATGCTCCTCTGAAGAGACTTTCCTCATTG ACTGCCGAGGCCCCATGAATCAATGTCTGGTAGCCACCGG | SEQ ID NO: 2818 |
| PLK | NM_005030.2 | AATGAATACAGTATTCCCAAGCACATC AACCCCGTGGCCGCCTCCCTCATCCAGAAGATGCTTCAGACA | SEQ ID NO: 2819 |
| PLK3 | NM_004073.2 | TGAAGGAGACGTACCGCTGCATCAAGC AGGTTCACTACACGCTGCCTGCCAGCCTCTCACTGCCTG | SEQ ID NO: 2820 |
| PLOD2 | NM_000935.2 | CAGGGAGGTGGTTGCAAATTTCTAAGGTACAATT GCTCTATTGAGTCACCACGAAAAGGCTGGAGCTTCATGCATCCTGGGAGA | SEQ ID NO: 2821 |

TABLE B-continued

| Gene | Locus Link | Sequence | Sequence ID Number |
|---|---|---|---|
| PMS1 | NM_000534.2 | CTTACGGTTTTCGTGGAGAAGCCTTGGGGTCAATTT GTTGTATAGCTGAGGTTTTAATTACAACAAGAACGGCTGCT | SEQ ID NO: 2822 |
| PMS2 | NM_000535.2 | GATGTGGACTGCCATTCAAACCAGGAAGATACCGGATGT AAATTTCGAGTTTTGCCTCAGCCAACTAATCTCGCA | SEQ ID NO: 2823 |
| PPARG | NM_005037.3 | TGACTTTATGGAGCCCAAGTTTGAGTTTG CTGTGAAGTTCAATGCACTGGAATTAGATGACAGCGACTTGGC | SEQ ID NO: 2824 |
| PPID | NM_005038.1 | TCCTCATTTGGATGGGAAACATGTGGTGT TTGGCCAAGTAATTAAAGGAATAGGAGTGGCAAGGATATTGG | SEQ ID NO: 2825 |
| PPM1D | NM_003620.1 | GCCATCCGCAAAGGCTTTCTCGCTT GTCACCTTGCCATGTGGAAGAAACTGGCGGAATGGCC | SEQ ID NO: 2826 |
| PPP2R4 | NM_178001.1 | GGCTCAGAGCATAAGGCTTCAGGGCCCAAGTTGGG AGAAGTGACCAAAGTGTAGCCAGTTTTCTGAGTTCCCGT | SEQ ID NO: 2827 |
| PR | NM_000926.2 | GCATCAGGCTGTCATTATGGTGTCCTTACCTGTGGGAGC TGTAAGGTCTTCTTTAAGAGGGCAATGGAAGGGCAGCACAACTACT | SEQ ID NO: 2828 |
| PRDX2 | NM_005809.4 | GGTGTCCTTCGCCAGATCACTGTTAAT GATTTGCCTGTGGGACGCTCCGTGGATGAGGCTCTGCGGCTG | SEQ ID NO: 2829 |
| PRDX3 | NM_006793.2 | TGACCCCAATGGAGTCATCAAGCATTTGAGCGTCAACGAT CTCCCAGTGGGCCGAAGCGTGGAAGAAACCCTCCGCTTGG | SEQ ID NO: 2830 |
| PRDX4 | NM_006406.1 | TTACCCATTTGGCCTGGATTAATACCCCTCGAAGAC AAGGAGGACTTGGGCCAATAAGGATTCCACTTCTTTCAG | SEQ ID NO: 2831 |
| PRDX6 | NM_004905.2 | CTGTGAGCCAGAGGATGTCAGCTGCCAATTGTGT TTTCCTGCAGCAATTCCATAAACACATCCTGGTGTCATCACA | SEQ ID NO: 2832 |
| PRKCA | NM_002737.1 | CAAGCAATGCGTCATCAATGTCCCC AGCCTCTGCGGAATGGATCACACTGAGAAGAGGGGGCGGATTTAC | SEQ ID NO: 2833 |
| PRKCB1 | NM_002738.5 | GACCCAGCTCCACTCCTGCTTCC AGACCATGGACCGCCTGTACTTTGTGATGGAGTACGTGAATGGG | SEQ ID NO: 2834 |
| PRKCD | NM_006254.1 | CTGACACTTGCCGCAGAGAATCCC TTTCTCACCCACCTCATCTGCACCTTCCAGACCAAGGACCACCT | SEQ ID NO: 2835 |
| PRKR | NM_002759.1 | GCGATACATGAGCCCAGAACAGATTTCTTCGCAAGA CTATGGAAAGGAAGTGGACCTCTACGCTTTGGGGCTAATTCTTGCTGA | SEQ ID NO: 2836 |
| pS2 | NM_003225.1 | GCCCTCCCAGTGTGCAAATAAGGGCTGCTGTTTCGACGACA CCGTTCGTGGGGTCCCCTGGTGCTTCTATCCTAATACCATCGACG | SEQ ID NO: 2837 |
| PTCH | NM_000264.2 | CCACGACAAAGCCGACTACATGCCTGAAA CAAGGCTGAGAATCCCGGCAGCAGAGCCCATCGAGTA | SEQ ID NO: 2838 |
| PTEN | NM_000314.1 | TGGCTAAGTGAAGATGACAATCATGTTGCAGCAATTCA CTGTAAAGCTGGAAAGGGACGAACTGGTGTAATGATATGTGCA | SEQ ID NO: 2839 |
| PTGER3 | NM_000957.2 | TAACTGGGGCAACCTTTTCTTCGCCTCTGCCTTTGCCTT CCTGGGGCTCTTGGCGCTGACAGTCACCTTTTCCTGCAA | SEQ ID NO: 2840 |
| PTHLH | NM_002820.1 | AGTGACTGGGAGTGGGCTAGAAGGGGACCACCTGTCTGAC ACCTCCACAACGTCGCTGGAGCTCGATTCACGGTAACAGGCTT | SEQ ID NO: 2841 |
| PTHR1 | NM_000316.1 | CGAGGTACAAGCTGAGATCAAGAAATCTTGGAGCCGCTG GACACTGGCACTGGACTTCAAGCGAAAGGCACGC | SEQ ID NO: 2842 |
| PTK2 | NM_005607.3 | GACCGGTCGAATGATAAGGTGTACGAGAATGTGA CGGGCCTGGTGAAAGCTGTCATCGAGATGTCCAG | SEQ ID NO: 2843 |
| PTK2B | NM_004103.3 | CAAGCCCAGCCGACCTAAGTACAGACCCCCTCCGC AAACCAACCTCCTGGCTCCAAAGCTGCAGTTCCAGGTTC | SEQ ID NO: 2844 |
| PTP4A3 | NM_007079.2 | AATATTTGTGCGGGGTATGGGGGTGGGTTTTT AAATCTCGTTTCTCTTGGACAAGCACAGGGATCTCGTT | SEQ ID NO: 2845 |
| PTP4A3 v2 | NM_032611.1 | CCTGTTCTCGGCACCTTAAATTATT AGACCCCGGGGCAGTCAGGTGCTCCGGACACCCGAAGGCAATA | SEQ ID NO: 2846 |

TABLE B-continued

| Gene | Locus Link | Sequence | Sequence ID Number |
|---|---|---|---|
| PTPD1 | NM_007039.2 | CGCTTGCCTAACTCATACTTTCCCGTTGACACTTGATCCACG CAGCGTGGCACTGGGACGTAAGTGGCGCAGTCTGAATGG | SEQ ID NO: 2847 |
| PTPN1 | NM_002827.2 | AATGAGGAAGTTTCGGATGGGGCTGATCCAGACAGCCGACC AGCTGCGCTTCTCCTACCTGGCTGTGATCGAAG | SEQ ID NO: 2848 |
| PTPRF | NM_002840.2 | TGTTTTAGCTGAGGGACGTGGTGCCGACGTCCCCA AACCTAGCTAGGCTAAGTCAAGATCAACATTCCAGGGTTGGTA | SEQ ID NO: 2849 |
| PTPRJ | NM_002843.2 | AACTTCCGGTACCTCGTTCGTGACTACATGAAGCAGA GTCCTCCCGAATCGCCGATTCTGGTGCATTGCAGTGCT | SEQ ID NO: 2850 |
| PTPRO | NM_030667.1 | CATGGCCTGATCATGGTGTGCCCACAGC AAATGCTGCAGAAAGTATCCTGCAGTTTGTACACATGG | SEQ ID NO: 2851 |
| PTTG1 | NM_004219.2 | GGCTACTCTGATCTATGTTGATAAGGAAAATGGAG AACCAGGCACCCGTGTGGTTGCTAAGGATGGGCTGAAGC | SEQ ID NO: 2852 |
| RAB32 | NM_006834.2 | CCTGCAGCTGTGGGACATCGCGGGGCAGGAGCGATTTGGC AACATGACCCGAGTATACTACAAGGAAGCTGTTGGTGCT | SEQ ID NO: 2853 |
| RAB6C | NM_032144.1 | GCGACAGCTCCTCAGTTCCACCATGTCCGCGGGCGGAGACTT CGGGAATCCGCTGAGGAAATTCAAGCTGGTGTTCC | SEQ ID NO: 2854 |
| RAC1 | NM_006908.3 | TGTTGTAAATGTCTCAGCCCCTCGTTCTTGGTCCTG TCCCTTGGAACCTTTGTACGCTTTGCTCAA | SEQ ID NO: 2855 |
| RAD51C | NM_058216.1 | GAACTTCTTGAGCAGGAGCATACCCAGGGCTTCATAATCA CCTTCTGTTCAGCACTAGATGATATTCTTGGGGGTGGA | SEQ ID NO: 2856 |
| RAD54L | NM_003579.2 | AGCTAGCCTCAGTGACACACATGACAGGTTGCACT GCCGACGTTGTGTCAACAGCCGTCAGATCCGG | SEQ ID NO: 2857 |
| RAF1 | NM_002880.1 | CGTCGTATGCGAGAGTCTGTTTCCAGGATGCCTGTTAG TTCTCAGCACAGATATTCTACACCTCACGCCTTCA | SEQ ID NO: 2858 |
| RALBP1 | NM_006788.2 | GGTGTCAGATATAAATGTGCAAATGCCTTCTTGCTGTCCTGTCGGT CTCAGTACGTTCACTTTATAGCTGCTGGCAATATCGAA | SEQ ID NO: 2859 |
| RANBP2 | NM_006267.3 | TCCTTCAGCTTTCACACTGGGCTCAGAAATGAAGTTG CATGACTCTTCTGGAAGTCAGGTGGGAACAGGATTT | SEQ ID NO: 2860 |
| ranBP7 | NM_006391.1 | AACATGATTATCCAAGCCGCTGGACTGCCATTGTGGACAAAATTGGCTTTTA TCTTCAGTCCGATAACAGTGCTTGTTGGC | SEQ ID NO: 2861 |
| RANBP9 | NM_005493.2 | CAAGTCAGTTGAGACGCCAGTTGTGTGGAGGAAGTC AGGCCGCCATAGAAAGAATGATCCACTTTGGACGAGAGCTGCA | SEQ ID NO: 2862 |
| RAP1GDS1 | NM_021159.3 | TGTGGATGCTGGATTGATTTCACCACTGGTGCAGC TGCTAAATAGCAAAGACCAGGAAGTGCTGCTT | SEQ ID NO: 2863 |
| RARA | NM_000964.1 | AGTCTGTGAGAAACGACCGAAACAAGAAGAAGAAGGAGGTGCC CAAGCCCGAGTGCTCTGAGAGCTACACGCTGACGCCG | SEQ ID NO: 2864 |
| RARB | NM_016152.2 | TGCCTGGACATCCTGATTCTTAGAATTTGCACCAGGTATACC CCAGAACAAGACACCATGACTTTCTCAGACGGCCTT | SEQ ID NO: 2865 |
| RASSF1 | NM_007182.3 | AGTGGGAGACACCTGACCTTTCTCAAGCTGAGATTG AGCAGAAGATCAAGGAGTACAATGCCCAGATCA | SEQ ID NO: 2866 |
| RBM5 | NM_005778.1 | CGAGAGGGAGAGCAAGACCATCATGCTGCGCGGCCTT CCCATCACCATCACAGAGAGCGATATTCGAGA | SEQ ID NO: 2867 |
| RBX1 | NM_014248.2 | GGAACCACATTATGGATCTTTGCATAGAATGTCAAGCTAACCA GGCGTCCGCTACTTCAGAAGAGTGTACTGTCGCATG | SEQ ID NO: 2868 |
| RCC1 | NM_001269.2 | GGGCTGGGTGAGAATGTGATGGAGAGGAAGAAGCCG GCCCTGGTATCCATTCCGGAGGATGTTGTG | SEQ ID NO: 2869 |
| REG4 | NM_032044.2 | TGCTAACTCCTGCACAGCCCCGTCCTCTTCCTTTCTGCTAGCCTGGC TAAATCTGCTCATTATTTCAGAGGGGAAACCTAGCA | SEQ ID NO: 2870 |
| RFC | NM_003056.1 | TCAAGACCATCATCACTTTCATTGTCTCGGA CGTGCGGGGCCTGGGCCTCCCGGTCCGCA AGCAGTTCCAGTTATACTCCGTGTACTTCCTGATCC | SEQ ID NO: 2871 |

TABLE B-continued

| Gene | Locus Link | Sequence | Sequence ID Number |
|---|---|---|---|
| RhoB | NM_004040.2 | AAGCATGAACAGGACTTGACCATCTTTCCAACCCC TGGGGAAGACATTTGCAACTGACTTGGGGAGG | SEQ ID NO: 2872 |
| rhoC | NM_175744.1 | CCCGTTCGGTCTGAGGAAGGCCGGGACATGGCGAAC CGGATCAGTGCCTTTGGCTACCTTGAGTGCTC | SEQ ID NO: 2873 |
| RIZ1 | NM_012231.1 | CCAGACGAGCGATTAGAAGCGGCAGCTTGTGAGGTGAAT GATTTGGGGGAAGAGGAGGAGGAGGAAGAGGAGGA | SEQ ID NO: 2874 |
| RNF11 | NM_014372.3 | ACCCTGGAAGAGATGGATCAGAAAAAAAGATCCGGGAGTGTGTGAT CTGTATGATGGACTTTGTTTATGGGGACCCAAT | SEQ ID NO: 2875 |
| ROCK1 | NM_005406.1 | TGTGCACATAGGAATGAGCTTCAGATGCAGTTGGCCAGCAAA GAGAGTGATATTGAGCAATTGCGTGCTAAAC | SEQ ID NO: 2876 |
| ROCK2 | NM_004850.3 | GATCCGAGACCCTCGCTCCCCCATCAACGTGGAG AGCTTGCTGGATGGCTTAAATTCCTTGGTCCT | SEQ ID NO: 2877 |
| RPLP0 | NM_001002.2 | CCATTCTATCATCAACGGGTACAAACGAGTCCTGGCCTTGTCTG TGGAGACGGATTACACCTTCCCACTTGCTGA | SEQ ID NO: 2878 |
| RPS13 | NM_001017.2 | CAGTCGGCTTTACCCTATCGACGCAGCGTCCC CACTTGGTTGAAGTTGACATCTGACGACGTGAAGGAGCAGA | SEQ ID NO: 2879 |
| RRM1 | NM_001033.1 | GGGCTACTGGCAGCTACATTGCTGGGACTAATGGCA ATTCCAATGGCCTTGTACCGATGCTGAGAG | SEQ ID NO: 2880 |
| RRM2 | NM_001034.1 | CAGCGGGATTAAACAGTCCTTTAACCAGCACAGC CAGTTAAAAGATGCAGCCTCACTGCTTCAACGCAGAT | SEQ ID NO: 2881 |
| RTN4 | NM_007008.1 | GACTGGAGTGGTGTTTGGTGCCAGCCTATTCCTGCTGC TTTCATTGACAGTATTCAGCATTGTGAGCGTAACAG | SEQ ID NO: 2882 |
| RUNX1 | NM_001754.2 | AACAGAGACATTGCCAACCATATTGGATCTGCTTGC TGTCCAAACCAGCAAACTTCCTGGGCAAATCAC | SEQ ID NO: 2883 |
| RXRA | NM_002957.3 | GCTCTGTTGTGTCCTGTTGCCGGCTCTGGCCTTC CTGTGACTGACTGTGAAGTGGCTTCTCCGTAC | SEQ ID NO: 2884 |
| S100A1 | NM_006271.1 | TGGACAAGGTGATGAAGGAGCTAGACGAGAATGGAGAC GGGGAGGTGGACTTCCAGGAGTATGTGGTGCT | SEQ ID NO: 2885 |
| S100A2 | NM_005978.2 | TGGCTGTGCTGGTCACTACCTTCCACAAGTACTCCTGCCAAGA GGGCGACAAGTTCAAGCTGAGTAAGGGGGA | SEQ ID NO: 2886 |
| S100A4 | NM_002961.2 | GACTGCTGTCATGGCGTGCCCTCTGGAGAAGGCC CTGGATGTGATGGTGTCCACCTTCCACAAGTACTCG | SEQ ID NO: 2887 |
| S100A8 | NM_002964.3 | ACTCCCTGATAAAGGGGAATTTCCATGCCGTCTA CAGGGATGACCTGAAGAAATTGCTAGAGACCGAGTGTCCTCA | SEQ ID NO: 2888 |
| S100A9 | NM_002965.2 | CTTTGGGACAGAGTGCAAGACGATGACTTGC AAAATGTCGCAGCTGGAACGCAACATAGAGACCA | SEQ ID NO: 2889 |
| S100P | NM_005980.2 | AGACAAGGATGCCGTGGATAAATTGCTCAAGGACCT GGACGCCAATGGAGATGCCCAGGTGGACTTC | SEQ ID NO: 2890 |
| SAT | NM_002970.1 | CCTTTTACCACTGCCTGGTTGCAGAAGTGCCGAAAG AGCACTGGACTCCGGAAGGACACAGCATTGT | SEQ ID NO: 2891 |
| SBA2 | NM_018639.3 | GGACTCAACGATGGGCAGATCAAGATCTGGGA GGTGCAGACAGGGCTCCTGCTTTTGAATCTTTCCG | SEQ ID NO: 2892 |
| SDC1 | NM_002997.1 | GAAATTGACGAGGGGTGTCTTGGGCAGAGCTGGCTCTGAGCGCCT CCATCCAAGGCCAGGTTCTCCGTTAGCTCCT | SEQ ID NO: 2893 |
| SEMA3B | NM_004636.1 | GCTCCAGGATGTGTTTCTGTTGTCCTCGCGGGAC CACCGGACCCCGCTGCTCTATGCCGTCTTCTCCACGT | SEQ ID NO: 2894 |
| SEMA3F | NM_004186.1 | CGCGAGCCCCTCATTATACACTGGGCAGCCTCCCCACAG CGCATCGAGGAATGCGTGCTCTCAGGCAAGGATGTCAACGGCGAGTG | SEQ ID NO: 2895 |
| SEMA4B | NM_020210.1 | TTCCAGCCCAACACAGTGAACACT TTGGCCTGCCCGCTCCTCTCCAACCTGGCGACCCGACTC | SEQ ID NO: 2896 |

TABLE B-continued

| Gene | Locus Link | Sequence | Sequence ID Number |
|---|---|---|---|
| SFRP2 | NM_003013.2 | CAAGCTGAACGGTGTGTCCGAAAGGGACC TGAAGAAATCGGTGCTGTGGCTCAAAGACAGCTTGCA | SEQ ID NO: 2897 |
| SFRP4 | NM_003014.2 | TACAGGATGAGGCTGGGCATTGCCTGGGACA GCCTATGTAAGGCCATGTGCCCCTTGCCCTAACAAC | SEQ ID NO: 2898 |
| SGCB | NM_000232.1 | CAGTGGAGACCAGTTGGGTAGTGGTGACTGGGTA CGCTACAAGCTCTGCATGTGTGCTGATGGGACGCTCTTCAAGG | SEQ ID NO: 2899 |
| SHC1 | NM_003029.3 | CCAACACCTTCTTGGCTTCTGGGACCTG TGTTCTTGCTGAGCACCCTCTCCGGTTTGGGTTGGGATAACAG | SEQ ID NO: 2900 |
| SHH | NM_000193.2 | GTCCAAGGCACATATCCACTGCTCGGTGAAA GCAGAGAACTCGGTGGCGGCCAAATCGGGAGGCTGCTTC | SEQ ID NO: 2901 |
| SI | NM_001041.1 | AACGGACTCCCTCAATTTGTGCAAGATTTGCATGACCA TGGACAGAAATATGTCATCATCTTGGACCCTGCAATTTC | SEQ ID NO: 2902 |
| Siah-1 | NM_003031.2 | TTGGCATTGGAACTACATTCAATCCGCGGTATCC TCGGATTAGTTCTAGGACCCCCTTCTCCATACC | SEQ ID NO: 2903 |
| SIAT4A | NM_003033.2 | AACCACAGTTGGAGGAGGACGGCAGAGACA GTTTCCCTCCCCGCTATACCAACACCCTTCCTTCG | SEQ ID NO: 2904 |
| SIAT7B | NM_006456.1 | TCCAGCCCAAATCCTCCTGGTGGCACATCCTACCCC AGATGCTAAAGTGATTCAAGGACTCCAGGACACC | SEQ ID NO: 2905 |
| SIM2 | NM_005069.2 | GATGGTAGGAAGGGATGTGCCCGCCTCTCCACG CACTCAGCTATACCTCATTCACAGCTCCTTGTG | SEQ ID NO: 2906 |
| SIN3A | NM_015477.1 | CCAGAGTCATGCTCATCCAGCCCCACCAGTTGCACC AGTGCAGGGACAGCAGCAATTTCAGAGGCTGAAGGTGG | SEQ ID NO: 2907 |
| SIR2 | NM_012238.3 | AGCTGGGGTGTCTGTTTCATGTGGAATACCTGACTT CAGGTCAAGGGATGGTATTTATGCTCGCCTTGCTGT | SEQ ID NO: 2908 |
| SKP1A | NM_006930.2 | CCATTGCCTTTGCTTTGTTCATAATTTCAGC AGGGCAGAATAAAAACCATGGGAGGCAAAGAAAGGAAATCCGGAA | SEQ ID NO: 2909 |
| SKP2 | NM_005983.2 | AGTTGCAGAATCTAAGCCTGGAAGGCCTGC GGCTTTCGGATCCCATTGTCAATACTCTCGCAAAAAACTCA | SEQ ID NO: 2910 |
| SLC25A3 | NM_213611.1 | TCTGCCAGTGCTGAATTCTTTGCTGACATTGCCCTGG CTCCTATGGAAGCTGCTAAGGTTCGAA | SEQ ID NO: 2911 |
| SLC2A1 | NM_006516.1 | GCCTGAGTCTCCTGTGCCCACATCCCAGGCTTCA CCCTGAATGGTTCCATGCCTGAGGGTGGAGACT | SEQ ID NO: 2912 |
| SLC31A1 | NM_001859.2 | CCGTTCGAAGAGTCGTGAGGGGGTGACGGGTTAAG ATTCGGAGAGAGAGGTGCTAGTGGCTGGACT | SEQ ID NO: 2913 |
| SLC5A8 | NM_145913.2 | CCTGCTTTCAACCACATTGAATTGAACTCAGA TCAGAGTGGCAAGAGCAATGGGACTCGTTTGTGAAGCTGCTCT | SEQ ID NO: 2914 |
| SLC7A5 | NM_003486.4 | GCGCAGAGGCCAGTTAAAGTAGATCACCTCCTCG AACCCACTCCGGTTCCCCGCAACCCACAGCTCAGCT | SEQ ID NO: 2915 |
| SLPI | NM_003064.2 | ATGGCCAATGTTTGATGCTTAACCCCCCAATTTCTGTG AGATGGATGGCCAGTGCAAGCGTGACTTGAAGTGT | SEQ ID NO: 2916 |
| SMARCA3 | NM_003071.2 | AGGGACTGTCCTGGCACATTATGCAGATGTCC TGGGTCTTTTGCTTAGACTGCGGCAAATTTGTTG | SEQ ID NO: 2917 |
| SNAI1 | NM_005985.2 | CCCAATCGGAAGCCTAACTACAGCGAGCTGCAGGA CTCTAATCCAGAGTTTACCTTCCAGCAGCCCTAC | SEQ ID NO: 2918 |
| SNAI2 | NM_003068.3 | GGCTGGCCAAACATAAGCAGCTGCACTGCGATGCCCAG TCTAGAAAATCTTTCAGCTGTAAATACTGTGACAAGGA | SEQ ID NO: 2919 |
| SNRPF | NM_003095.1 | GGCTGGTCGGCAGAGAGTAGCCTGCAACATTCGGCCGT GGTTTACATGAGTTTACCCCTCAATCCCAAACCTTTCCTCA | SEQ ID NO: 2920 |
| SOD1 | NM_000454.3 | TGAAGAGAGGCATGTTGGAGACTTGGGCAATGTG ACTGCTGACAAAGATGGTGTGGCCGATGTGTCTATT | SEQ ID NO: 2921 |

TABLE B-continued

| Gene | Locus Link | Sequence | Sequence ID Number |
|---|---|---|---|
| SOD2 | NM_000636.1 | GCTTGTCCAAATCAGGATCCACTGCAAGGAACAACA GGCCTTATTCCACTGCTGGGGATTGATGTGTGGGAGCACGCT | SEQ ID NO: 2922 |
| SOS1 | NM_005633.2 | TCTGCACCAAATTCTCCAAGAACACCGTTAAC ACCTCCGCCTGCTTCTGGTGCTTCCAGTACCAC | SEQ ID NO: 2923 |
| SOX17 | NM_022454.2 | TCGTGTGCAAGCCTGAGATGGGCCTCCCCTAC CAGGGGCATGACTCCGGTGTGAATCTCCCCGACAG | SEQ ID NO: 2924 |
| SPARC | NM_003118.1 | TCTTCCCTGTACACTGGCAGTTCGGCCAGCTGGACCAGC ACCCCATTGACGGGTACCTCTCCCACACCGAGCT | SEQ ID NO: 2925 |
| SPIND2 | NM_021102.1 | AGGAATGCAGCGGATTCCTCTGTCCCAAGTGC TCCCAGAAGGCAGGATTCTGAAGACCACTCCAGCGA | SEQ ID NO: 2926 |
| SPRY1 | AK026960.1 | CAGACCAGTCCCTGGTCATAGGTCTGAAAGGGCAATCCGGACCC AGCCCAAGCAACTGATTGTGGATGACTTGAAGG | SEQ ID NO: 2927 |
| SPRY2 | NM_005842.1 | TGTGGCAAGTGCAAATGTAAGGAGTGC ACCTACCCAAGGCCTCTGCCATCAGACTGGATCTGCGAC | SEQ ID NO: 2928 |
| SR-A1 | NM_021228.1 | AGATGGAAGAAGCCAACCTGGCGAGCCGAGCGAAGGC CAGGAGCTGATCCAGGCCACCAACCAGATCCTCAGCCACAG | SEQ ID NO: 2929 |
| ST14 | NM_021978.2 | TGACTGCACATGGAACATTGAGGTGCCCAACAA CCAGCATGTGAAGGTGCGCTTCAAATTCTT | SEQ ID NO: 2930 |
| STAT1 | NM_007315.1 | GGGCTCAGCTTTCAGAAGTGCTGAGTTGGCAGTTTT CTTCTGTCACCAAAAGAGGTCTCAATGTGGACCAGCTGAACATGT | SEQ ID NO: 2931 |
| STAT3 | NM_003150.1 | TCACATGCCACTTTGGTGTTTCATAATC TCCTGGGAGAGATTGACCAGCAGTATAGCCGCTTCCTGCAAG | SEQ ID NO: 2932 |
| STAT5A | NM_003152.1 | GAGGCGCTCAACATGAAATTCAAGGCCGAAGTGCAGAGCAACCG GGGCCTGACCAAGGAGAACCTCGTGTTCCTGGC | SEQ ID NO: 2933 |
| STAT5B | NM_012448.1 | CCAGTGGTGGTGATCGTTCATGGCA GCCAGGACAACAATGCGACGGCCACTGTTCTCTGGGACAATGCTTTTGC | SEQ ID NO: 2934 |
| STC1 | NM_003155.1 | CTCCGAGGTGAGGAGGACTCTCCCTCCCACATCAA ACGCACATCCCATGAGAGTGCATAACCAGGGAGAGGT | SEQ ID NO: 2935 |
| STK11 | NM_000455.3 | GGACTCGGAGACGCTGTGCAGGAGGGC CGTCAAGATCCTCAAGAAGAAGAAGTTGCGAAGGATCCC | SEQ ID NO: 2936 |
| STK15 | NM_003600.1 | CATCTTCCAGGAGGACCACTCTCTGTGGC ACCCTGGACTACCTGCCCCCTGAAATGATTGAAGGTCGGA | SEQ ID NO: 2937 |
| STMN1 | NM_005563.2 | AATACCCAACGCACAAATGACCGCACGTTCTCTGCC CCGTTTCTTGCCCCAGTGTGGTTTGCATTGTCTCC | SEQ ID NO: 2938 |
| STMY3 | NM_005940.2 | CCTGGAGGCTGCAACATACCTCAATCCTGTCCCAGGCCGGATCCTCCT GAAGCCCTTTTCGCAGCACTGCTATCCTCCAAAGCCATTGTA | SEQ ID NO: 2939 |
| STS | NM_000351.2 | GAAGATCCCTTTCCTCCTACTGTTCTTTCTGTG GGAAGCCGAGAGCCACGAAGCATCAAGGCCGAACATCATCC | SEQ ID NO: 2940 |
| SURV | NM_001168.1 | TGTTTTGATTCCCGGGCTTACCAGGTGAGAAGTGAGGGAG GAAGAAGGCAGTGTCCCTTTTGCTAGAGCTGACAGCTTTG | SEQ ID NO: 2941 |
| TAGLN | NM_003186.2 | GATGGAGCAGGTGGCTCAGTTCCTGAAGGCGGCTGAGG ACTCTGGGGTCATCAAGACTGACATGTTCCAGACT | SEQ ID NO: 2942 |
| TBP | NM_003194.1 | GCCCGAAACGCCGAATATAATCCCAAGCGGTTTGC TGCGGTAATCATGAGGATAAGAGAGCCACG | SEQ ID NO: 2943 |
| TCF-1 | NM_000545.3 | GAGGTCCTGAGCACTGCCAGGAGGGACAAAGGAGCCT GTGAACCCAGGACAAGCATGGTCCCACATC | SEQ ID NO: 2944 |
| TCF-7 | NM_003202.2 | GCAGCTGCAGTCAACAGTTCAAAGAAGTCA TGGCCCAAATCCAGTGTGCACCCCTCCCCATTCACAG | SEQ ID NO: 2945 |
| TCF7L1 | NM_031283.1 | CCGGGACACTTTCAGAAGCCGCGGGACTA TTTCGCCGAAGTGAGAAGGCCTCAGGACAGCGCGTTCT | SEQ ID NO: 2946 |

TABLE B-continued

| Gene | Locus Link | Sequence | Sequence ID Number |
|---|---|---|---|
| TCF7L2 | NM_030756.1 | CCAATCACGACAGGAGGATTCAGACACCCCT ACCCCACAGCTCTGACCGTCAATGCTTCCGTGTCCA | SEQ ID NO: 2947 |
| TCFL4 | NM_170607.2 | CTGACTGCTCTGCTTAAAGGTGAAAGTAGCAGGAACAACAAC AAAAGCCAACCAAAAACAAGGTAGCCAGTGCAAGACAT | SEQ ID NO: 2948 |
| TEK | NM_000459.1 | ACTTCGGTGCTACTTAACAACTTACATCCCAGGGA GCAGTACGTGGTCCGAGCTAGAGTCAACACCAAGGCCCAGG | SEQ ID NO: 2949 |
| TERC | U86046.1 | AAGAGGAACGGAGCGAGTCCCCGCGCGCGGCGCGATTCCC TGAGCTGTGGGACGTGCACCCAGGACTCGGCTCACACAT | SEQ ID NO: 2950 |
| TERT | NM_003219.1 | GACATGGAGAACAAGCTGTTTGCGGGGATTCGGCGGGAC GGGCTGCTCCTGCGTTTGGTGGATGATTTCTTGTTGGTGACACCTC | SEQ ID NO: 2951 |
| TFF3 | NM_003226.1 | AGGCACTGTTCATCTCAGTTTTTCTGTCCCTTTG CTCCCCGGCAAGCTTTCTGCTGAAAGTTCATATCTGGAGCCTGATG | SEQ ID NO: 2952 |
| TGFA | NM_003236.1 | GGTGTGCCACAGACCTTCCTACTTGGCCTGTAATCACCTGTGC AGCCTTTTGTGGGCCTTCAAAACTCTGTCAAGAACTCCGT | SEQ ID NO: 2953 |
| TGFB2 | NM_003238.1 | ACCAGTCCCCCAGAAGACTATCCTGAGCCCGAGGAAG TCCCCCCGGAGGTGATTTCCATCTACAACAGCACCAGG | SEQ ID NO: 2954 |
| TGFB3 | NM_003239.1 | GGATCGAGCTCTTCCAGATCCTTCGGCCAGATG AGCACATTGCCAAACAGCGCTATATCGGTGGC | SEQ ID NO: 2955 |
| TGFBI | NM_000358.1 | GCTACGAGTGCTGTCCTGGATATGAAAAGGTCCCTG GGGAGAAGGGCTGTCCAGCAGCCCTACCACT | SEQ ID NO: 2956 |
| TGFBR1 | NM_004612.1 | GTCATCACCTGGCCTTGGTCCTGTGGAACTGGC AGCTGTCATTGCTGGACCAGTGTGCTTCGTCTGC | SEQ ID NO: 2957 |
| TGFBR2 | NM_003242.2 | AACACCAATGGGTTCCATCTTTCTGGGCTCC TGATTGCTCAAGCACAGTTTGGCCTGATGAAGAGG | SEQ ID NO: 2958 |
| THBS1 | NM_003246.1 | CATCCGCAAAGTGACTGAAGAGAACAAAGAGTTGGCCAATGA GCTGAGGCGGCCTCCCCTATGCTATCACAACGGAGTTCAGTAC | SEQ ID NO: 2959 |
| THY1 | NM_006288.2 | GGACAAGACCCTCTCAGGCTGTCCCAAGCTCCC AAGAGCTTCCAGAGCTCTGACCCACAGCCTCCAA | SEQ ID NO: 2960 |
| TIMP1 | NM_003254.1 | TCCCTGCGGTCCCAGATAGCCTGAATCCTGCCCGGAGTGGAAC TGAAGCCTGCACAGTGTCCACCCTGTTCCCAC | SEQ ID NO: 2961 |
| TIMP2 | NM_003255.2 | TCACCCTCTGTGACTTCATCGTGCCCTGGGACACCC TGAGCACCACCCAGAAGAAGAGCCTGAACCACA | SEQ ID NO: 2962 |
| TIMP3 | NM_000362.2 | CTACCTGCCTTGCTTTGTGACTTCCAAGAACG AGTGTCTCTGGACCGACATGCTCTCCAATTTCGGT | SEQ ID NO: 2963 |
| TJP1 | NM_003257.1 | ACTTTGCTGGGACAAAGGTCAACTGAAGAAGTGGGCAGGCC CGAGGCAGGAGAGATGCTGAGGAGTCCATGTG | SEQ ID NO: 2964 |
| TK1 | NM_003258.1 | GCCGGGAAGACCGTAATTGTGGCTGCACTGGATGGGACCT TCCAGAGGAAGCCATTTGGGGCCATCCTGAACCTGGTGCCGCTG | SEQ ID NO: 2965 |
| TLN1 | NM_006289.2 | AAGCAGAAGGGAGAGCGTAAGATCTTCCAGGCACACAA GAATTGTGGGCAGATGAGTGAGATTGAGGCCAAGG | SEQ ID NO: 2966 |
| TMEPAI | NM_020182.3 | CAGAAGGATGCCTGTGGCCCTCGGAGAGCACAGT GTCAGGCAACGGAATCCCAGAGCCGCAGGTCTAC | SEQ ID NO: 2967 |
| TMSB10 | NM_021103.2 | GAAATCGCCAGCTTCGATAAGGCCAAGCTGAA GAAAACGGAGACGCAGGAAAAGAACACCCTGCCGAC | SEQ ID NO: 2968 |
| TMSB4X | NM_021109.2 | CACATCAAAGAACTACTGACAACGAAGGC CGCGCCTGCCTTTCCCATCTGTCTATCTATCTGGCTGGCAGG | SEQ ID NO: 2969 |
| TNC | NM_002160.1 | AGCTCGGAACCTCACCGTGCCTGGCAGCCTTC GGGCTGTGGACATACCGGGCCTCAAGGCTGCTAC | SEQ ID NO: 2970 |
| TNF | NM_000594.1 | GGAGAAGGGTGACCGACTCAGCGCTGAGATCAATCG GCCCGACTATCTCGACTTTGCCGAGTCTGGGCA | SEQ ID NO: 2971 |

TABLE B-continued

| Gene | Locus Link | Sequence | Sequence ID Number |
|---|---|---|---|
| TNFRSF5 | NM_001250.3 | TCTCACCTCGCTATGGTTCGTCTGCCTCTGCAGTGCGTCC TCTGGGGCTGCTTGCTGACCGCTGTCCATC | SEQ ID NO: 2972 |
| TNFRSF6B | NM_003823.2 | CCTCAGCACCAGGGTACCAGGAGCTGAGGAGTG TGAGCGTGCCGTCATCGACTTTGTGGCTTTCCAGGACA | SEQ ID NO: 2973 |
| TNFSF4 | NM_003326.2 | CTTCATCTTCCCTCTACCCAGATTGTGAAGATGGAAAGGGT CCAACCCCTGGAAGAGAATGTGGGAAATGCAGC | SEQ ID NO: 2974 |
| TOP2A | NM_001067.1 | AATCCAAGGGGAGAGTGATGACTTCCATATGGACTTTGA CTCAGCTGTGGCTCCTCGGGCAAAATCTGTAC | SEQ ID NO: 2975 |
| TOP2B | NM_001068.1 | TGTGGACATCTTCCCCTCAGACTTCCCTACTGAGC CACCTTCTCTGCCACGAACCGGTCGGGCTAG | SEQ ID NO: 2976 |
| TP | NM_001953.2 | CTATATGCAGCCAGAGATGTGACAGCCACCGTGGACAGCCTGCCACTC ATCACAGCCTCCATTCTCAGTAAGAAACTCGTGG | SEQ ID NO: 2977 |
| TP53BP1 | NM_005657.1 | TGCTGTTGCTGAGTCTGTTGCCAGTCCCCAGAA GACCATGTCTGTGTTGAGCTGTATCTGTGAAGCCAGGCAAG | SEQ ID NO: 2978 |
| TP53BP2 | NM_005426.1 | GGGCCAAATATTCAGAAGCTTTTATATCAGAGGACCACCA TAGCGGCCATGGAGACCATCTCTGTCCCATCATACCCATCC | SEQ ID NO: 2979 |
| TP53I3 | NM_004881.2 | GCGGACTTAATGCAGAGACAAGGCCAGTATGAC CCACCTCCAGGAGCCAGCAACATTTTGGGACTTGA | SEQ ID NO: 2980 |
| TRAG3 | NM_004909.1 | GACGCTGGTCTGGTGAAGATGTCCAGGAAACCA CGAGCCTCCAGCCCATTGTCCAACAACCACCCA | SEQ ID NO: 2981 |
| TRAIL | NM_003810.1 | CTTCACAGTGCTCCTGCAGTCTCTCTGTGTGGCTGTAACTTA CGTGTACTTTACCAACGAGCTGAAGCAGATG | SEQ ID NO: 2982 |
| TS | NM_001071.1 | GCCTCGGTGTGCCTTTCAACATCGCCAGCTACGCC CTGCTCACGTACATGATTGCGCACATACG | SEQ ID NO: 2983 |
| TST | NM_003312.4 | GGAGCCGGATGCAGTAGGACTGGACTCGGGCCA TATCCGTGGTGCCGTCAACATGCCTTTCATGGACTT | SEQ ID NO: 2984 |
| TUBA1 | NM_006000.1 | TGTCACCCCGACTCAACGTGAGACGCACCGCCC GGACTCACCATGCGTGAATGCATCTCAGTCCACGT | SEQ ID NO: 2985 |
| TUBB | NM_001069.1 | CGAGGACGAGGCTTAAAAACTTCTCAGATCAATCGT GCATCCTTAGTGAACTTCTGTTGTCCTCAAGCATGGT | SEQ ID NO: 2986 |
| TUFM | NM_003321.3 | GTATCACCATCAATGCGGCTCATGTGGAGTATAGCACT GCCGCCCGCCACTACGCCCACACAGACTG | SEQ ID NO: 2987 |
| TULP3 | NM_003324.2 | TGTGTATAGTCCTGCCCCTCAAGGTGTCACAGT AAGATGTCGGATAATCCGGGATAAAAGGGGAATGGATCGGG | SEQ ID NO: 2988 |
| tusc4 | NM_006545.4 | GGAGGAGCTAAATGCCTCAGGCCGGTGCACTCT GCCCATTGATGAGTCCAACACCATCCACTTGAAGG | SEQ ID NO: 2989 |
| UBB | NM_018955.1 | GAGTCGACCCTGCACCTGGTCCTGCGTCTGA GAGGTGGTATGCAGATCTTCGTGAAGACCCTGACCGGCA AGACCATCACCCTGGAAGTGGAGCCCAGTGACACCAT CGAAAATGTGAAGGCCAAGATCCAGGATAAAGAA GGCATCCCTCCCGACCAGCAGAGGCTCATCTTTGC AGGCAAGCAGCTGGAAGATGGCCGCACTCTTTCTG ACTACAACATCCAGAAGGAGTCGACCCTGCACCTGG TCCTGCGTCTGAGAGGTGGTATGCAGATCTTCGTG AAGACCCTGACCGGCAAGACCATCACTCTGGAAGTG GAGCCCAGTGACACCATCGAAAATGTGAAGGCCA AGATCCAAGATAAAGAAGGCATCCCTCCCGACCAG CAGAGGCTCATCTTTGCAGGCAAGCAGCTGGAAGAT GGCCGCACTCTTTCTGACTACAACATCCAGAAGGAGT CGACCCTGCACCTGGTCCTGCGCCTGAGGGGTG GCTGTTAATTCTTCAGTCATGGCATTCGC | SEQ ID NO: 2990 |
| UBC | NM_021009.2 | ACGCACCCTGTCTGACTACAACATCCAGAAAGA GTCCACCCTGCACCTGGTGCTCCGTCTTAGAGGT | SEQ ID NO: 2991 |
| UBE2C | NM_007019.2 | TGTCTGGCGATAAAGGGATTTCTGCCTTCCC TGAATCAGACAACCTTTTCAAATGGGTAGGGACCAT | SEQ ID NO: 2992 |

TABLE B-continued

| Gene | Locus Link | Sequence | Sequence ID Number |
|---|---|---|---|
| UBE2M | NM_003969.1 | CTCCATAATTTATGGCCTGCAGTATCTCTTCTTGGAGCC CAACCCCGAGGACCCACTGAACAAGGAGGCCGCA | SEQ ID NO: 2993 |
| UBL1 | NM_003352.3 | GTGAAGCCACCGTCATCATGTCTGACCAGGAGGCAAA ACCTTCAACTGAGGACTTGGGGGATAAGAAGGAAGG | SEQ ID NO: 2994 |
| UCP2 | NM_003355.2 | ACCATGCTCCAGAAGGAGGGGCCCCGAGC CTTCTACAAAGGGTTCATGCCCTCCTTTCTCCGCTTGGGTT | SEQ ID NO: 2995 |
| UGT1A1 | NM_000463.2 | CCATGCAGCCTGGAATTTGAGGCTACCCAG TGCCCCAACCCATTCTCCTACGTGCCCAGGCCTCTC | SEQ ID NO: 2996 |
| UMPS | NM_000373.1 | TGCGGAAATGAGCTCCACCGGCTCCCTGGCCACTGG GGACTACACTAGAGCAGCGGTTAGAATGGCTGAGG | SEQ ID NO: 2997 |
| UNC5A | XM_030300.7 | GACAGCTGATCCAGGAGCCACGGGTCCTGCACTTCAAG GACAGTTACCACAACCTGCGCCTATCCAT | SEQ ID NO: 2998 |
| UNC5B | NM_170744.2 | AGAACGGAGGCCGTGACTGCAGCGGGACGCTG CTCGACTCTAAGAACTGCACAGATGGGCTGTGCATG | SEQ ID NO: 2999 |
| UNC5C | NM_003728.2 | CTGAACACAGTGGAGCTGGTTTGCAAACTCTGTGTG CGGCAGGTGGAAGGAGAAGGGCAGATCTTCCAG | SEQ ID NO: 3000 |
| upa | NM_002658.1 | GTGGATGTGCCCTGAAGGACAAGCCAGGCGTCTACA CGAGAGTCTCACACTTCTTACCCTGGATCCGCAG | SEQ ID NO: 3001 |
| UPP1 | NM_003364.2 | ACGGGTCCTGCCTCAGTTGGCGGAATGGCGGCCACGGGA GCCAATGCAGAGAAAGCTGAAAGTCACAATGATTGCCCCG | SEQ ID NO: 3002 |
| VCAM1 | NM_001078.2 | TGGCTTCAGGAGCTGAATACCCTCCCAGGCACACAC AGGTGGGACACAAATAAGGGTTTTGGAACCACTATTTTCTCATCACGACAGCA | SEQ ID NO: 3003 |
| VCL | NM_003373.2 | GATACCACAACTCCCATCAAGCTGTTGGC AGTGGCAGCCACGGCGCCTCCTGATGCGCCTAACAGGGA | SEQ ID NO: 3004 |
| VCP | NM_007126.2 | GGCTTTGGCAGCTTCAGATTCCCTTCAGGGAACCAGG GTGGAGCTGGCCCCAGTCAGGGCAGTGGAG | SEQ ID NO: 3005 |
| VDAC1 | NM_003374.1 | GCTGCGACATGGATTTCGACATTGCTGGGCCTTCCATCCGG GGTGCTCTGGTGCTAGGTTACGAGGGCTGG | SEQ ID NO: 3006 |
| VDAC2 | NM_003375.2 | ACCCACGGACAGACTTGCGCGCGTCCAATG TGTATTCCTCCATCATATGCTGACCTTGGCAAAGCT | SEQ ID NO: 3007 |
| VDR | NM_000376.1 | GCCCTGGATTTCAGAAAGAGCCAAGTCTGGATCT GGGACCCTTTCCTTCCTTCCCTGGCTTGTAACT | SEQ ID NO: 3008 |
| VEGF | NM_003376.3 | CTGCTGTCTTGGGTGCATTGGAGCCTTGCCTTGCT GCTCTACCTCCACCATGCCAAGTGGTCCCAGGCTGC | SEQ ID NO: 3009 |
| VEGF_altsplice1 | AF486837.1 | TGTGAATGCAGACCAAAGAAAGATAGAG CAAGACAAGAAAATCCCTGTGGGCCTTGCTCAGAGCGGAGAAAGC | SEQ ID NO: 3010 |
| VEGF_altsplice2 | AF214570.1 | AGCTTCCTACAGCACAACAAATGTGAATGCAGACCAA AGAAAGATAGAGCAAGACAAGAAAAATGTGACAAGCCGAG | SEQ ID NO: 3011 |
| VEGFB | NM_003377.2 | TGACGATGGCCTGGAGTGTGTGCCCACTGGGCA GCACCAAGTCCGGATGCAGATCCTCATGATCCGGTACC | SEQ ID NO: 3012 |
| VEGFC | NM_005429.2 | CCTCAGCAAGACGTTATTTGAAATTACAGTGCCTCTCTCTCAAGGCC CCAAACCAGTAACAATCAGTTTTGCCAATCACACTT | SEQ ID NO: 3013 |
| VIM | NM_003380.1 | TGCCCTTAAAGGAACCAATGAGTCCCTGGAACGCCAG ATGCGTGAAATGGAAGAGAACTTTGCCGTTGAAGC | SEQ ID NO: 3014 |
| WIF | NM_007191.2 | TACAAGCTGAGTGCCCAGGCGGGTGCCGAAATGGA GGCTTTTGTAATGAAAGACGCATCTGCGAGTG | SEQ ID NO: 3015 |
| WISP1 | NM_003882.2 | AGAGGCATCCATGAACTTCACACTTGCGGGC TGCATCAGCACACGCTCCTATCAACCCAAGTACTGTGGAGTTTG | SEQ ID NO: 3016 |
| Wnt-3a | NM_033131.2 | ACAAAGCTACCAGGGAGTCGGCCTTTGTCCACGCCA TTGCCTCAGCCGGTGTGGCCTTTGCAGTGACACGCTCA | SEQ ID NO: 3017 |

TABLE B-continued

| Gene | Locus Link | Sequence | Sequence ID Number |
|---|---|---|---|
| Wnt-5a | NM_003392.2 | GTATCAGGACCACATGCAGTACATCGGAGAAG GCGCGAAGACAGGCATCAAAGAATGCCAGTATCAATTCCGACA | SEQ ID NO: 3018 |
| Wnt-5b | NM_032642.2 | TGTCTTCAGGGTCTTGTCCAGAATGTAGATGGGTTC CGTAAGAGGCCTGGTGCTCTCTTACTCTTTCATCCACGTGCAC | SEQ ID NO: 3019 |
| WND2 | NM_003391.1 | CGGTGGAATCTGGCTCTGGCTCCCTCTGC TCTTGACCTGGCTCACCCCCGAGGTCAACTCTTCATGG | SEQ ID NO: 3020 |
| WWOX | NM_016373.1 | ATCGCAGCTGGTGGGTGTACACACTGCTGTTT ACCTTGGCGAGGCCTTTCACCAAGTCCATGCAACAGGGAGCT | SEQ ID NO: 3021 |
| XPA | NM_000380.2 | GGGTAGAGGGAAAAGGGTTCAACAAAGGCTGAACTG GATTCTTAACCAAGAAACAAATAATAGCAATGGTGGTGCA | SEQ ID NO: 3022 |
| XPC | NM_004628.2 | GATACATCGTCTGCGAGGAATTCAAAGACGTGCTCC TGACTGCCTGGGAAAATGAGCAGGCAGTCATTGAAAG | SEQ ID NO: 3023 |
| XRCC1 | NM_006297.1 | GGAGATGAAGCCCCCAAGCTTCCTCAGA AGCAACGCCAGACCAAAACCAAGCCCACTCAGGCAGCTGGAC | SEQ ID NO: 3024 |
| YB-1 | NM_004559.1 | AGACTGTGGAGTTTGATGTTGTTGAAGGAGA AAAGGGTGCGGAGGCAGCAAATGTTACAGGTCCTGGTGGTGTTCC | SEQ ID NO: 3025 |
| YWHAH | NM_003405.2 | CATGGCCTCCGCTATGAAGGCGGTGACAGAG CTGAATGAACCTCTCTCCAATGAAGATCGAAATCTCC | SEQ ID NO: 3026 |
| zbtb7 | NM_015898.2 | CTGCGTTCACACCCCAGTGTCACAGGGCGA GCTGTTCTGGAGAGAAAACCATCTGTCGTGGCTGAG | SEQ ID NO: 3027 |
| ZG16 | NM_152338.1 | TGCTGAGCCTCCTCTCCTTGGCAGGGGCACTGTGATGA GGAGTAAGAACTCCCTTATCACTAACCCCCATCC | SEQ ID NO: 3028 |

SEQUENCE LISTING (3028 sequences)

SEQ ID NO: 1 - DNA, 23 bp, Artificial Sequence
  Synthetic DNA
cgttccgatcctctatactgcat

SEQ ID NO: 2 - DNA, 25 bp, Artificial Sequence
  Synthetic DNA
atgcctacagcaccctgatgtcgca

SEQ ID NO: 3 - DNA, 22 bp, Artificial Sequence
  Synthetic DNA
aggtccctgttggccttatagg

SEQ ID NO: 4 - DNA, 20 bp, Artificial Sequence
  Synthetic DNA
aaacaccactggagcattga

SEQ ID NO: 5 - DNA, 24 bp, Artificial Sequence
  Synthetic DNA
ctcgccaatgatgctgctcaagtt

SEQ ID NO: 6 - DNA, 20 bp, Artificial Sequence
  Synthetic DNA
caagcctggaacctatagcc

SEQ ID NO: 7 - DNA, 20 bp, Artificial Sequence
  Synthetic DNA
tgcagactgtaccatgctga

SEQ ID NO: 8 - DNA, 22 bp, Artificial Sequence
  Synthetic DNA
ctgcacacggttctaggctccg

SEQ ID NO: 9 - DNA, 20 bp, Artificial Sequence
  Synthetic DNA
ggccagcaccataatcctat

SEQ ID NO: 10 - DNA, 18 bp, Artificial Sequence
  Synthetic DNA
ggatgaacctcgacctgc

SEQ ID NO: 11 - DNA, 24 bp, Artificial Sequence
  Synthetic DNA
ccagatagcctcgtccgagtgctc

SEQ ID NO: 12 - DNA, 18 bp, Artificial Sequence
  Synthetic DNA
gagctgcaccgtctccag

SEQ ID NO: 13 - DNA, 19 bp, Artificial Sequence
  Synthetic DNA
gctaccaagtccgtgctgt

SEQ ID NO: 14 - DNA, 28 bp, Artificial Sequence
  Synthetic DNA
tgatcgacaaatgttacccagacacaca

SEQ ID NO: 15 - DNA, 20 bp, Artificial Sequence
  Synthetic DNA
gaaaactgcttctgcaatgg

SEQ ID NO: 16 - DNA, 20 bp, Artificial Sequence
  Synthetic DNA
cccatcaacttgtgccagta

SEQ ID NO: 17 - DNA, 24 bp, Artificial Sequence
  Synthetic DNA
tgcctactccactgcacagaccct

SEQ ID NO: 18 - DNA, 19 bp, Artificial Sequence
  Synthetic DNA
ggtgatggttcgaccactg

SEQ ID NO: 19 - DNA, 20 bp, Artificial Sequence
  Synthetic DNA
gaagtgccaggaggcgatta

SEQ ID NO: 20 - DNA, 28 bp, Artificial Sequence
  Synthetic DNA
tgctacttgcaaaggcgtgtcctactgc

SEQ ID NO: 21 - DNA, 21 bp, Artificial Sequence
  Synthetic DNA
cgggcactcactgctattacc

SEQ ID NO: 22 - DNA, 19 bp, Artificial Sequence
  Synthetic DNA
ggagaagggtggagtgcag

SEQ ID NO: 23 - DNA, 24 bp, Artificial Sequence
  Synthetic DNA
cgcacagtcagaatccatctgggt

SEQ ID NO: 24 - DNA, 20 bp, Artificial Sequence
  Synthetic DNA
cagggtcaggtctctggatg

SEQ ID NO: 25 - DNA, 20 bp, Artificial Sequence
  Synthetic DNA
ttgacaacctgctggacatc

SEQ ID NO: 26 - DNA, 24 bp, Artificial Sequence
  Synthetic DNA
ccctgagcagactgtaggccacct

SEQ ID NO: 27 - DNA, 20 bp, Artificial Sequence
  Synthetic DNA
atgggatccttgctgctatc

SEQ ID NO: 28 - DNA, 18 bp, Artificial Sequence
  Synthetic DNA
cttttccctccagtggca

SEQ ID NO: 29 - DNA, 24 bp, Artificial Sequence
  Synthetic DNA
ctcctggaaacagtccacttgggc

SEQ ID NO: 30 - DNA, 20 bp, Artificial Sequence
  Synthetic DNA
atttggaaggcactgggttt

SEQ ID NO: 31 - DNA, 20 bp, Artificial Sequence
  Synthetic DNA
tagagagcccctgacaatcc

SEQ ID NO: 32 - DNA, 25 bp, Artificial Sequence
  Synthetic DNA
tggctctagctcctgatgaagcctc

SEQ ID NO: 33 - DNA, 20 bp, Artificial Sequence
  Synthetic DNA
ggttggtcttggaaagagga

SEQ ID NO: 34 - DNA, 20 bp, Artificial Sequence
  Synthetic DNA
cgcttctatggcgctgagat

SEQ ID NO: 35 - DNA, 24 bp, Artificial Sequence
  Synthetic DNA
cagccctggactacctgcactcgg

SEQ ID NO: 36 - DNA, 20 bp, Artificial Sequence
  Synthetic DNA
tcccggtacaccacgttctt

SEQ ID NO: 37 - DNA, 19 bp, Artificial Sequence
  Synthetic DNA
tcctgccacccttcaaacc

SEQ ID NO: 38 - DNA, 24 bp, Artificial Sequence
  Synthetic DNA
caggtcacgtccgaggtcgacaca

SEQ ID NO: 39 - DNA, 21 bp, Artificial Sequence
  Synthetic DNA
ggcggtaaattcatcatcgaa

SEQ ID NO: 40 - DNA, 25 bp, Artificial Sequence
  Synthetic DNA
ttgtctctgccttggactatctaca

SEQ ID NO: 41 - DNA, 23 bp, Artificial Sequence
  Synthetic DNA
tcacggtacacaatctttccgga

SEQ ID NO: 42 - DNA, 24 bp, Artificial Sequence
  Synthetic DNA
ccagcattagattctccaacttga

SEQ ID NO: 43 - DNA, 21 bp, Artificial Sequence
  Synthetic DNA
caagaagaggctctaccctgg

SEQ ID NO: 44 - DNA, 24 bp, Artificial Sequence
  Synthetic DNA
actgggaatttccaaggccacctt

SEQ ID NO: 45 - DNA, 20 bp, Artificial Sequence
  Synthetic DNA
aaatgagctctgcgatcctc

SEQ ID NO: 46 - DNA, 21 bp, Artificial Sequence
  Synthetic DNA
gaggaatatggaatccaaggg

SEQ ID NO: 47 - DNA, 24 bp, Artificial Sequence
  Synthetic DNA
ccagttcctgccgtctgctcttct

SEQ ID NO: 48 - DNA, 18 bp, Artificial Sequence
  Synthetic DNA
gtggcggagatcaagagg

SEQ ID NO: 49 - DNA, 25 bp, Artificial Sequence
  Synthetic DNA
gaaggagataaggaggatgttgaca

SEQ ID NO: 50 - DNA, 26 bp, Artificial Sequence
  Synthetic DNA
agtgaaggccgcaagacaggcttttc

SEQ ID NO: 51 - DNA, 18 bp, Artificial Sequence
  Synthetic DNA
cgccacggagatccaatc

SEQ ID NO: 52 - DNA, 18 bp, Artificial Sequence
  Synthetic DNA
gcctgtacgtgccagctc

SEQ ID NO: 53 - DNA, 24 bp, Artificial Sequence
  Synthetic DNA
tgccagagcctcaactgtctctgc

SEQ ID NO: 54 - DNA, 19 bp, Artificial Sequence
  Synthetic DNA
tcatcggagcttgatctcg

SEQ ID NO: 55 - DNA, 21 bp, Artificial Sequence
  Synthetic DNA
gatggttcagctctgcaagga

SEQ ID NO: 56 - DNA, 30 bp, Artificial Sequence
  Synthetic DNA
cgatttgaatatctttccttctcgcccacc

SEQ ID NO: 57 - DNA, 18 bp, Artificial Sequence
  Synthetic DNA
tcgaccgtggctgctcat

SEQ ID NO: 58 - DNA, 20 bp, Artificial Sequence
  Synthetic DNA
ccgtgaaagctgctctgtaa

SEQ ID NO: 59 - DNA, 24 bp, Artificial Sequence
  Synthetic DNA
aagctgacacagccctcccaagtg

SEQ ID NO: 60 - DNA, 20 bp, Artificial Sequence
  Synthetic DNA
ttgcagtgggaagaacagtc

SEQ ID NO: 61 - DNA, 20 bp, Artificial Sequence
  Synthetic DNA
ctccaggtgtacctccaacc

SEQ ID NO: 62 - DNA, 24 bp, Artificial Sequence
  Synthetic DNA
agccttctcccacagctgcctaca

SEQ ID NO: 63 - DNA, 20 bp, Artificial Sequence
  Synthetic DNA
gagaaggctgggagactctg

SEQ ID NO: 64 - DNA, 22 bp, Artificial Sequence
  Synthetic DNA
gcccctatcctaccttcaatcc

SEQ ID NO: 65 - DNA, 19 bp, Artificial Sequence
  Synthetic DNA
tcctcggatgtcgctgcct

SEQ ID NO: 66 - DNA, 24 bp, Artificial Sequence
  Synthetic DNA
cctttaaccattatggccttatgc

SEQ ID NO: 67 - DNA, 23 bp, Artificial Sequence
  Synthetic DNA
caagacactaagggcgactacca

SEQ ID NO: 68 - DNA, 24 bp, Artificial Sequence
  Synthetic DNA
ccaccacacaggtacagcagcgct

SEQ ID NO: 69 - DNA, 19 bp, Artificial Sequence
  Synthetic DNA
cgtgtcgggcttcagtcat

SEQ ID NO: 70 - DNA, 20 bp, Artificial Sequence
  Synthetic DNA
gctcaagcctggaagatgac

SEQ ID NO: 71 - DNA, 24 bp, Artificial Sequence
  Synthetic DNA
agtaccctgaagtgtcccccacca

SEQ ID NO: 72 - DNA, 19 bp, Artificial Sequence
  Synthetic DNA
agaaccaccaacatccgct

SEQ ID NO: 73 - DNA, 20 bp, Artificial Sequence
  Synthetic DNA
gactgcaaagatggaaacga

SEQ ID NO: 74 - DNA, 24 bp, Artificial Sequence
  Synthetic DNA
ctatgacgatgccctcaacgcctc

SEQ ID NO: 75 - DNA, 20 bp, Artificial Sequence
  Synthetic DNA
tagccataaggtccgctctc

SEQ ID NO: 76 - DNA, 20 bp, Artificial Sequence
  Synthetic DNA
ggacagcaggaatgtgtttc

SEQ ID NO: 77 - DNA, 22 bp, Artificial Sequence
  Synthetic DNA
cattggctccccgtgacctgta

SEQ ID NO: 78 - DNA, 20 bp, Artificial Sequence
  Synthetic DNA
acccactcgatttgtttctg

SEQ ID NO: 79 - DNA, 20 bp, Artificial Sequence
  Synthetic DNA
gatgaagcctttcgcaagtt

SEQ ID NO: 80 - DNA, 21 bp, Artificial Sequence
  Synthetic DNA
ctttcgggaagccaggccctt

SEQ ID NO: 81 - DNA, 20 bp, Artificial Sequence
  Synthetic DNA
aggtctccacacagcacaag

SEQ ID NO: 82 - DNA, 19 bp, Artificial Sequence
  Synthetic DNA
accccggcctgtatatcat

SEQ ID NO: 83 - DNA, 24 bp, Artificial Sequence
  Synthetic DNA
ccaatggctcgagttcttgatccc

SEQ ID NO: 84 - DNA, 21 bp, Artificial Sequence
  Synthetic DNA
ctatctggctctttgctgcat

SEQ ID NO: 85 - DNA, 22 bp, Artificial Sequence
  Synthetic DNA
ccaccttggaccaaagtaaagc

SEQ ID NO: 86 - DNA, 22 bp, Artificial Sequence
  Synthetic DNA
ctccccaacacgctgaaacccg

SEQ ID NO: 87 - DNA, 21 bp, Artificial Sequence
  Synthetic DNA
tctcagcgtcacctggtagga

SEQ ID NO: 88 - DNA, 21 bp, Artificial Sequence
  Synthetic DNA
ggaaacacactggaggacaag

SEQ ID NO: 89 - DNA, 24 bp, Artificial Sequence
  Synthetic DNA
tcatcagccgcatcaaacagagtg

SEQ ID NO: 90 - DNA, 19 bp, Artificial Sequence
  Synthetic DNA
cgcatcttggcagaaagtt

SEQ ID NO: 91 - DNA, 27 bp, Artificial Sequence
  Synthetic DNA
tgtgagtgaaatgccttctagtagtga

SEQ ID NO: 92 - DNA, 23 bp, Artificial Sequence
  Synthetic DNA
ccgtcctcgggagccgactatga

SEQ ID NO: 93 - DNA, 27 bp, Artificial Sequence
  Synthetic DNA
ttgtggttcgttatcatactcttctga

SEQ ID NO: 94 - DNA, 21 bp, Artificial Sequence
  Synthetic DNA
cgcagtgcagctgagtatctg

SEQ ID NO: 95 - DNA, 23 bp, Artificial Sequence
  Synthetic DNA
tcgcaccaggaagctgccattga

SEQ ID NO: 96 - DNA, 21 bp, Artificial Sequence
  Synthetic DNA
tgcccagggctactctcactt

SEQ ID NO: 97 - DNA, 20 bp, Artificial Sequence
  Synthetic DNA
actggcccacttagtcctca

SEQ ID NO: 98 - DNA, 23 bp, Artificial Sequence
  Synthetic DNA
ctcccaacctgctgtccctcaag

SEQ ID NO: 99 - DNA, 20 bp, Artificial Sequence
  Synthetic DNA
ctgaactccacaggctggta

SEQ ID NO: 100 - DNA, 18 bp, Artificial Sequence
  Synthetic DNA
gcagccacctgcaacttt

SEQ ID NO: 101 - DNA, 24 bp, Artificial Sequence
  Synthetic DNA
caggcgagagagcatcccgtctac

SEQ ID NO: 102 - DNA, 18 bp, Artificial Sequence
  Synthetic DNA
tccaggagggacagctca

SEQ ID NO: 103 - DNA, 20 bp, Artificial Sequence
  Synthetic DNA
gatgctgccactcaacaact

SEQ ID NO: 104 - DNA, 24 bp, Artificial Sequence
  Synthetic DNA
agttagacgcacgccacgactcaa

SEQ ID NO: 105 - DNA, 20 bp, Artificial Sequence
  Synthetic DNA
tgtccttgcttcagcaactc

SEQ ID NO: 106 - DNA, 18 bp, Artificial Sequence
  Synthetic DNA
ccgctttcgctacagcat

SEQ ID NO: 107 - DNA, 24 bp, Artificial Sequence
  Synthetic DNA
tccagcctgtctccagtaggccac

SEQ ID NO: 108 - DNA, 21 bp, Artificial Sequence
  Synthetic DNA
tgggagtatcggatgtagctg

SEQ ID NO: 109 - DNA, 21 bp, Artificial Sequence
  Synthetic DNA
agctgcagaagagctgcacat

SEQ ID NO: 110 - DNA, 22 bp, Artificial Sequence
  Synthetic DNA
tgacgagcagcgaacagccacg

SEQ ID NO: 111 - DNA, 20 bp, Artificial Sequence
  Synthetic DNA
gcatctgccaactcctccat

SEQ ID NO: 112 - DNA, 20 bp, Artificial Sequence
  Synthetic DNA
ggctatgtctttgcaccagc

SEQ ID NO: 113 - DNA, 24 bp, Artificial Sequence
  Synthetic DNA
accagcgccaacgacagtgagata

SEQ ID NO: 114 - DNA, 18 bp, Artificial Sequence
  Synthetic DNA
atccgtcagcgcatcact

SEQ ID NO: 115 - DNA, 18 bp, Artificial Sequence
  Synthetic DNA
ccgtgtgacagcatcgtt

SEQ ID NO: 116 - DNA, 24 bp, Artificial Sequence
  Synthetic DNA
cgtactacttctgcggggaaccca

SEQ ID NO: 117 - DNA, 18 bp, Artificial Sequence
  Synthetic DNA
ctcaccagggtgcggtag

SEQ ID NO: 118 - DNA, 22 bp, Artificial Sequence
  Synthetic DNA
ggctcttgtgcgtactgtcctt

SEQ ID NO: 119 - DNA, 29 bp, Artificial Sequence
  Synthetic DNA
aggctcagtgatgtcttccctgtcaccag

SEQ ID NO: 120 - DNA, 23 bp, Artificial Sequence
  Synthetic DNA
tcagatgacgaagagcacagatg

SEQ ID NO: 121 - DNA, 19 bp, Artificial Sequence
  Synthetic DNA
gggtcaggtgcctcgagat

SEQ ID NO: 122 - DNA, 24 bp, Artificial Sequence
  Synthetic DNA
tgggcccagagcatgttccagatc

SEQ ID NO: 123 - DNA, 21 bp, Artificial Sequence
  Synthetic DNA
ctgctcactcggctcaaactc

SEQ ID NO: 124 - DNA, 23 bp, Artificial Sequence
  Synthetic DNA
cgttgtcagcacttggaatacaa

SEQ ID NO: 125 - DNA, 26 bp, Artificial Sequence
  Synthetic DNA
cccaattaacatgacccggcaaccat

SEQ ID NO: 126 - DNA, 24 bp, Artificial Sequence
  Synthetic DNA
gttcaacctcttcctgtggactgt

SEQ ID NO: 127 - DNA, 19 bp, Artificial Sequence
  Synthetic DNA
ctaggggcaaaaagcatga

SEQ ID NO: 128 - DNA, 24 bp, Artificial Sequence
  Synthetic DNA
ttccatgccagacaggaaaaagca

SEQ ID NO: 129 - DNA, 20 bp, Artificial Sequence
  Synthetic DNA
ctaaatgcccaaggtgactg

SEQ ID NO: 130 - DNA, 21 bp, Artificial Sequence
  Synthetic DNA
gaaagtaagccaggcccagtt

SEQ ID NO: 131 - DNA, 27 bp, Artificial Sequence
  Synthetic DNA
cagaactccctcctggacacatcccaa

SEQ ID NO: 132 - DNA, 21 bp, Artificial Sequence
  Synthetic DNA
acctctttgcggatcacttga

SEQ ID NO: 133 - DNA, 20 bp, Artificial Sequence
  Synthetic DNA
ccattcccaccattctacct

SEQ ID NO: 134 - DNA, 21 bp, Artificial Sequence
  Synthetic DNA
acaccccagacgtcctggcct

SEQ ID NO: 135 - DNA, 20 bp, Artificial Sequence
  Synthetic DNA
gggaacatagacccaccaat

SEQ ID NO: 136 - DNA, 18 bp, Artificial Sequence
  Synthetic DNA
ccgccgtggacacagact

SEQ ID NO: 137 - DNA, 25 bp, Artificial Sequence
  Synthetic DNA
tgccactcggaaaaagacctctcgg

SEQ ID NO: 138 - DNA, 21 bp, Artificial Sequence
  Synthetic DNA
ttgccgtcagaaaacatgtca

SEQ ID NO: 139 - DNA, 20 bp, Artificial Sequence
  Synthetic DNA
cctggagggtcctgtacaat

SEQ ID NO: 140 - DNA, 24 bp, Artificial Sequence
  Synthetic DNA
catcatgggactcctgcccttacc

SEQ ID NO: 141 - DNA, 19 bp, Artificial Sequence
  Synthetic DNA
ctaattgggctccatctcg

SEQ ID NO: 142 - DNA, 20 bp, Artificial Sequence
  Synthetic DNA
ccccgagacaacggagataa

SEQ ID NO: 143 - DNA, 23 bp, Artificial Sequence
  Synthetic DNA
ctttccgttggcatccgcaacag

SEQ ID NO: 144 - DNA, 19 bp, Artificial Sequence
  Synthetic DNA
ctcgggtttggcctctttc

SEQ ID NO: 145 - DNA, 25 bp, Artificial Sequence
  Synthetic DNA
cagatggacctagtacccactgaga

SEQ ID NO: 146 - DNA, 22 bp, Artificial Sequence
  Synthetic DNA
ttccacgccgaaggacagcgat

SEQ ID NO: 147 - DNA, 24 bp, Artificial Sequence
  Synthetic DNA
cctatgatttaagggcatttttcc

SEQ ID NO: 148 - DNA, 19 bp, Artificial Sequence
  Synthetic DNA
gctgggatggcttttgtca

SEQ ID NO: 149 - DNA, 25 bp, Artificial Sequence
  Synthetic DNA
tcttcaggaccccctttccactggc

SEQ ID NO: 150 - DNA, 21 bp, Artificial Sequence
  Synthetic DNA
gcctggaccagctgttttctc

SEQ ID NO: 151 - DNA, 20 bp, Artificial Sequence
  Synthetic DNA
aattaccaagcagccgaaga

SEQ ID NO: 152 - DNA, 28 bp, Artificial Sequence
  Synthetic DNA
ccacccacgaatggttatcttacgactg

SEQ ID NO: 153 - DNA, 20 bp, Artificial Sequence
  Synthetic DNA
caggcggacaatgtaacgta

SEQ ID NO: 154 - DNA, 18 bp, Artificial Sequence
  Synthetic DNA
aacccacccctgtcttgg

SEQ ID NO: 155 - DNA, 24 bp, Artificial Sequence
  Synthetic DNA
tccgggtagctctcaaactcgagg

SEQ ID NO: 156 - DNA, 18 bp, Artificial Sequence
  Synthetic DNA
ctcagctgacgggaaagg

SEQ ID NO: 157 - DNA, 24 bp, Artificial Sequence
  Synthetic DNA
cttttgtggaactctatgggaaca

SEQ ID NO: 158 - DNA, 20 bp, Artificial Sequence
  Synthetic DNA
ttcggctctcggctgctgca

SEQ ID NO: 159 - DNA, 19 bp, Artificial Sequence
  Synthetic DNA
cagcggttgaagcgttcct

SEQ ID NO: 160 - DNA, 26 bp, Artificial Sequence
  Synthetic DNA
tgtactggcgaagaatatttggtaaa

SEQ ID NO: 161 - DNA, 24 bp, Artificial Sequence
  Synthetic DNA
cagggcatcgatctctcaccctgg

SEQ ID NO: 162 - DNA, 20 bp, Artificial Sequence
  Synthetic DNA
gccacgtgattcttccacaa

SEQ ID NO: 163 - DNA, 24 bp, Artificial Sequence
  Synthetic DNA
ccaggaagaatgcttaagatgtga

SEQ ID NO: 164 - DNA, 26 bp, Artificial Sequence
  Synthetic DNA
ttcgccaggtcattgagatccatcca

SEQ ID NO: 165 - DNA, 24 bp, Artificial Sequence
  Synthetic DNA
tggtgatgggagttgtattttcag

SEQ ID NO: 166 - DNA, 18 bp, Artificial Sequence
  Synthetic DNA
gagctccgcaaggatgac

SEQ ID NO: 167 - DNA, 24 bp, Artificial Sequence
  Synthetic DNA
caagggtctccagcacctctacgc

SEQ ID NO: 168 - DNA, 20 bp, Artificial Sequence
  Synthetic DNA
cttgttgttcaccaggacga

SEQ ID NO: 169 - DNA, 20 bp, Artificial Sequence
  Synthetic DNA
ggactgtgaggtcaacaacg

SEQ ID NO: 170 - DNA, 24 bp, Artificial Sequence
  Synthetic DNA
tgtgatgcactcatccctgaggct

SEQ ID NO: 171 - DNA, 20 bp, Artificial Sequence
  Synthetic DNA
ggaagccaaacaccagtagg

SEQ ID NO: 172 - DNA, 23 bp, Artificial Sequence
  Synthetic DNA
attcctatggctctgcaattgtc

SEQ ID NO: 173 - DNA, 23 bp, Artificial Sequence
  Synthetic DNA
ccggttaactgtggcctgtgccc

SEQ ID NO: 174 - DNA, 21 bp, Artificial Sequence
  Synthetic DNA
ggcaggagtgaatggctcttc

SEQ ID NO: 175 - DNA, 20 bp, Artificial Sequence
  Synthetic DNA
cctgcaaaagggaacaagag

SEQ ID NO: 176 - DNA, 21 bp, Artificial Sequence
  Synthetic DNA
cttcgcctccagatggctccc

SEQ ID NO: 177 - DNA, 20 bp, Artificial Sequence
  Synthetic DNA
cgtggttgactctgatctcg

SEQ ID NO: 178 - DNA, 20 bp, Artificial Sequence
  Synthetic DNA
ggttgctgcctccatcaaag

SEQ ID NO: 179 - DNA, 27 bp, Artificial Sequence
  Synthetic DNA
acatcacagccaaaccacacagcctct

SEQ ID NO: 180 - DNA, 24 bp, Artificial Sequence
  Synthetic DNA
ccagcttgctattgaagtgttttc

SEQ ID NO: 181 - DNA, 20 bp, Artificial Sequence
  Synthetic DNA
atgtggacgctctttcaatg

SEQ ID NO: 182 - DNA, 24 bp, Artificial Sequence
  Synthetic DNA
accgcagtccgtctaagaagcacg

SEQ ID NO: 183 - DNA, 20 bp, Artificial Sequence
  Synthetic DNA
accatggtcgacctttagga

SEQ ID NO: 184 - DNA, 18 bp, Artificial Sequence
  Synthetic DNA
gggctagccattgaggtg

SEQ ID NO: 185 - DNA, 24 bp, Artificial Sequence
  Synthetic DNA
ctcacctccatcagactcggaccc

SEQ ID NO: 186 - DNA, 20 bp, Artificial Sequence
  Synthetic DNA
gctaatcctgacatgctggc

SEQ ID NO: 187 - DNA, 22 bp, Artificial Sequence
  Synthetic DNA
tcgtggaacatgacaaggaatt

SEQ ID NO: 188 - DNA, 23 bp, Artificial Sequence
  Synthetic DNA
ttccacccacgctaccaccatcg

SEQ ID NO: 189 - DNA, 22 bp, Artificial Sequence
  Synthetic DNA
tggaaagatcaaaccggaactc

SEQ ID NO: 190 - DNA, 20 bp, Artificial Sequence
  Synthetic DNA
ttggttcagcgaactattgc

SEQ ID NO: 191 - DNA, 24 bp, Artificial Sequence
  Synthetic DNA
caaacagattcagatggtccggca

SEQ ID NO: 192 - DNA, 20 bp, Artificial Sequence
  Synthetic DNA
tctccatatcggcctttacc

SEQ ID NO: 193 - DNA, 20 bp, Artificial Sequence
  Synthetic DNA
ccttccgaccagcagatgaa

SEQ ID NO: 194 - DNA, 25 bp, Artificial Sequence
  Synthetic DNA
caatttgggcaacgagaccgatcct

SEQ ID NO: 195 - DNA, 24 bp, Artificial Sequence
  Synthetic DNA
tttatatgcacattgggagctgat

SEQ ID NO: 196 - DNA, 20 bp, Artificial Sequence
  Synthetic DNA
tcagggggctagaaatctgt

SEQ ID NO: 197 - DNA, 23 bp, Artificial Sequence
  Synthetic DNA
ctatgggcccttcaccaacatgc

SEQ ID NO: 198 - DNA, 20 bp, Artificial Sequence
  Synthetic DNA
ccattccagttgatctgtgg

SEQ ID NO: 199 - DNA, 20 bp, Artificial Sequence
  Synthetic DNA
agttcgtgctttgcaagatg

SEQ ID NO: 200 - DNA, 29 bp, Artificial Sequence
  Synthetic DNA
cattcttcactgcttcataaagctctgca

SEQ ID NO: 201 - DNA, 20 bp, Artificial Sequence
  Synthetic DNA
aaggtaagctgggtctgctg

SEQ ID NO: 202 - DNA, 20 bp, Artificial Sequence
  Synthetic DNA
gtgcaggaaaggttcacaaa

SEQ ID NO: 203 - DNA, 24 bp, Artificial Sequence
  Synthetic DNA
agtgtctgcgtccaatacacgcgt

SEQ ID NO: 204 - DNA, 20 bp, Artificial Sequence
  Synthetic DNA
gcacacacgatggagtaagg

SEQ ID NO: 205 - DNA, 27 bp, Artificial Sequence
  Synthetic DNA
cagtgatccactttaacaaccctaaag

SEQ ID NO: 206 - DNA, 24 bp, Artificial Sequence
  Synthetic DNA
tcaggcatctctggcagcgaacac

SEQ ID NO: 207 - DNA, 21 bp, Artificial Sequence
  Synthetic DNA
agcatggcctgtaatggtgaa

SEQ ID NO: 208 - DNA, 20 bp, Artificial Sequence
  Synthetic DNA
gttgggacacagttggtctg

SEQ ID NO: 209 - DNA, 23 bp, Artificial Sequence
  Synthetic DNA
cagtcggcccaggacggtctact

SEQ ID NO: 210 - DNA, 20 bp, Artificial Sequence
  Synthetic DNA
tgaagcagtcagttgtgctg

SEQ ID NO: 211 - DNA, 21 bp, Artificial Sequence
  Synthetic DNA
ccgaggttaatccagcacgta

SEQ ID NO: 212 - DNA, 23 bp, Artificial Sequence
  Synthetic DNA
tgctgggagcctacacttggccc

SEQ ID NO: 213 - DNA, 21 bp, Artificial Sequence
  Synthetic DNA
aagacatggcgctctcagttc

SEQ ID NO: 214 - DNA, 24 bp, Artificial Sequence
  Synthetic DNA
tcaacagaaggctgaaccactaga

SEQ ID NO: 215 - DNA, 24 bp, Artificial Sequence
  Synthetic DNA
tacagtcccagcaccgacaattcc

SEQ ID NO: 216 - DNA, 22 bp, Artificial Sequence
  Synthetic DNA
caacagagtttgccgagacact

SEQ ID NO: 217 - DNA, 22 bp, Artificial Sequence
  Synthetic DNA
ctgaagcagatggttcatcatt

SEQ ID NO: 218 - DNA, 24 bp, Artificial Sequence
  Synthetic DNA
cctcgctttgtttaacagcccagg

SEQ ID NO: 219 - DNA, 22 bp, Artificial Sequence
  Synthetic DNA
gctgattcccaagagtctaacc

SEQ ID NO: 220 - DNA, 20 bp, Artificial Sequence
  Synthetic DNA
ccatctcgctgagatacgaa

SEQ ID NO: 221 - DNA, 28 bp, Artificial Sequence
  Synthetic DNA
gggagggtgtaccattacaggatcaaca

SEQ ID NO: 222 - DNA, 20 bp, Artificial Sequence
  Synthetic DNA
agacgtagagcttgccatca

SEQ ID NO: 223 - DNA, 25 bp, Artificial Sequence
  Synthetic DNA
gaggcaactgcttatggcttaatta

SEQ ID NO: 224 - DNA, 24 bp, Artificial Sequence
  Synthetic DNA
ttacagcgacagtcatggccgcat

SEQ ID NO: 225 - DNA, 18 bp, Artificial Sequence
  Synthetic DNA
ggcactcggcttgagcat

SEQ ID NO: 226 - DNA, 24 bp, Artificial Sequence
  Synthetic DNA
aactcagacttggaaatgccttct

SEQ ID NO: 227 - DNA, 26 bp, Artificial Sequence
  Synthetic DNA
aacttccacccccctcattggtcaca

SEQ ID NO: 228 - DNA, 27 bp, Artificial Sequence
  Synthetic DNA
ctggtctctatgaaatggtgttgtaac

SEQ ID NO: 229 - DNA, 23 bp, Artificial Sequence
  Synthetic DNA
tgaggagtggtattttggcaaga

SEQ ID NO: 230 - DNA, 24 bp, Artificial Sequence
  Synthetic DNA
aaccgctctgactcccgtctggtg

SEQ ID NO: 231 - DNA, 21 bp, Artificial Sequence
  Synthetic DNA
ctctcgggttctctgcattga

SEQ ID NO: 232 - DNA, 20 bp, Artificial Sequence
  Synthetic DNA
tcagctgtgagctgcggata

SEQ ID NO: 233 - DNA, 19 bp, Artificial Sequence
  Synthetic DNA
caggtcccattgccgggcg

SEQ ID NO: 234 - DNA, 24 bp, Artificial Sequence
  Synthetic DNA
acggtcctaggtttgaggttaaga

SEQ ID NO: 235 - DNA, 20 bp, Artificial Sequence
  Synthetic DNA
ccagcactgctcgttactgt

SEQ ID NO: 236 - DNA, 23 bp, Artificial Sequence
  Synthetic DNA
tgggacctcagaccactgaaggc

SEQ ID NO: 237 - DNA, 21 bp, Artificial Sequence
  Synthetic DNA
ttgacttcacggcagttcata

SEQ ID NO: 238 - DNA, 20 bp, Artificial Sequence
  Synthetic DNA
ctacgagtcagcccatccat

SEQ ID NO: 239 - DNA, 24 bp, Artificial Sequence
  Synthetic DNA
catggctaccacttcgacacagcc

SEQ ID NO: 240 - DNA, 18 bp, Artificial Sequence
  Synthetic DNA
tgcccacggctttcttac

SEQ ID NO: 241 - DNA, 20 bp, Artificial Sequence
  Synthetic DNA
atcctagccctggtttttgg

SEQ ID NO: 242 - DNA, 20 bp, Artificial Sequence
  Synthetic DNA
tttgctgtcaccagcgtcgc

SEQ ID NO: 243 - DNA, 20 bp, Artificial Sequence
  Synthetic DNA
ctgccttctcatctgcacaa

SEQ ID NO: 244 - DNA, 20 bp, Artificial Sequence
  Synthetic DNA
gaaggccaagaaccgagtca

SEQ ID NO: 245 - DNA, 27 bp, Artificial Sequence
  Synthetic DNA
ttatattccagtttaaggccaatcctc

SEQ ID NO: 246 - DNA, 24 bp, Artificial Sequence
  Synthetic DNA
tccccagttagttcaaaagtcaca

SEQ ID NO: 247 - DNA, 26 bp, Artificial Sequence
  Synthetic DNA
cactaaggtttgagacagttccagaa

SEQ ID NO: 248 - DNA, 26 bp, Artificial Sequence
  Synthetic DNA
aacccaagctcaagacgcaggacgag

SEQ ID NO: 249 - DNA, 23 bp, Artificial Sequence
  Synthetic DNA
gcgaattagccctctacaactga

SEQ ID NO: 250 - DNA, 20 bp, Artificial Sequence
  Synthetic DNA
gattgtcactgatggggagg

SEQ ID NO: 251 - DNA, 24 bp, Artificial Sequence
  Synthetic DNA
aggacctggatcatctcagcaggc

SEQ ID NO: 252 - DNA, 18 bp, Artificial Sequence
  Synthetic DNA
ccttcagagcaggcttgg

SEQ ID NO: 253 - DNA, 23 bp, Artificial Sequence
  Synthetic DNA
caagaagctgtacgagctcatca

SEQ ID NO: 254 - DNA, 22 bp, Artificial Sequence
  Synthetic DNA
ccgctactcggagcccgacctg

SEQ ID NO: 255 - DNA, 22 bp, Artificial Sequence
  Synthetic DNA
gcagcaaacgaaattgtcaaag

SEQ ID NO: 256 - DNA, 20 bp, Artificial Sequence
  Synthetic DNA
cctcggggatactgtctgat

SEQ ID NO: 257 - DNA, 27 bp, Artificial Sequence
  Synthetic DNA
caacaatcacaattttgcaaaagcacg

SEQ ID NO: 258 - DNA, 20 bp, Artificial Sequence
  Synthetic DNA
gaagtttgggcactttctcc

SEQ ID NO: 259 - DNA, 18 bp, Artificial Sequence
  Synthetic DNA
tgaatgccgtggattgca

SEQ ID NO: 260 - DNA, 25 bp, Artificial Sequence
  Synthetic DNA
cactagccctggaccagccactgct

SEQ ID NO: 261 - DNA, 21 bp, Artificial Sequence
  Synthetic DNA
acagggatcatgggacacaag

SEQ ID NO: 262 - DNA, 22 bp, Artificial Sequence
  Synthetic DNA
atccattcgatctcaccaaggt

SEQ ID NO: 263 - DNA, 28 bp, Artificial Sequence
  Synthetic DNA
tggcctcacaaggactaccctctcatcc

SEQ ID NO: 264 - DNA, 23 bp, Artificial Sequence
  Synthetic DNA
tccggtttaagaccagtttacca

SEQ ID NO: 265 - DNA, 20 bp, Artificial Sequence
  Synthetic DNA
gtggctcaacattgtgttcc

SEQ ID NO: 266 - DNA, 24 bp, Artificial Sequence
  Synthetic DNA
atttcagctgatcagtgggcctcc

SEQ ID NO: 267 - DNA, 20 bp, Artificial Sequence
  Synthetic DNA
caatggcctccattttacag

SEQ ID NO: 268 - DNA, 20 bp, Artificial Sequence
  Synthetic DNA
tcattcacaaacctggcagt

SEQ ID NO: 269 - DNA, 24 bp, Artificial Sequence
  Synthetic DNA
ttccggctgagctgtactcgtctg

SEQ ID NO: 270 - DNA, 20 bp, Artificial Sequence
  Synthetic DNA
catacccaatagcccactga

SEQ ID NO: 271 - DNA, 23 bp, Artificial Sequence
  Synthetic DNA
ccatgtgctgtaccaagagtttg

SEQ ID NO: 272 - DNA, 26 bp, Artificial Sequence
  Synthetic DNA
cagcactgacatcaaagcagccagga

SEQ ID NO: 273 - DNA, 18 bp, Artificial Sequence
  Synthetic DNA
cgccgcagaggtggagta

SEQ ID NO: 274 - DNA, 21 bp, Artificial Sequence
  Synthetic DNA
agcagacagtggtcagtcctt

SEQ ID NO: 275 - DNA, 24 bp, Artificial Sequence
  Synthetic DNA
ctctgctgacactcgagcccacat

SEQ ID NO: 276 - DNA, 20 bp, Artificial Sequence
  Synthetic DNA
ctgcatgattctgagcaggt

SEQ ID NO: 277 - DNA, 25 bp, Artificial Sequence
  Synthetic DNA
ccatacctcaagtatttgccatcag

SEQ ID NO: 278 - DNA, 29 bp, Artificial Sequence
  Synthetic DNA
attgctggagctgcctttcatttagcact

SEQ ID NO: 279 - DNA, 22 bp, Artificial Sequence
  Synthetic DNA
agctttgtcccgtgactgtgta

SEQ ID NO: 280 - DNA, 20 bp, Artificial Sequence
  Synthetic DNA
ttcaggttgttgcaggagac

SEQ ID NO: 281 - DNA, 27 bp, Artificial Sequence
  Synthetic DNA
tgtctccattattgatcggttcatgca

SEQ ID NO: 282 - DNA, 20 bp, Artificial Sequence
  Synthetic DNA
catcttcttgggcacacaat

SEQ ID NO: 283 - DNA, 22 bp, Artificial Sequence
  Synthetic DNA
aggcttctgcaggagactctgt

SEQ ID NO: 284 - DNA, 25 bp, Artificial Sequence
  Synthetic DNA
tcgatccataatgccaacgcacatg

SEQ ID NO: 285 - DNA, 22 bp, Artificial Sequence
  Synthetic DNA
gggaaactggctgaacctgtaa

SEQ ID NO: 286 - DNA, 21 bp, Artificial Sequence
  Synthetic DNA
gcatgttcgtggcctctaaga

SEQ ID NO: 287 - DNA, 23 bp, Artificial Sequence
  Synthetic DNA
aaggagaccatccccctgacggc

SEQ ID NO: 288 - DNA, 22 bp, Artificial Sequence
  Synthetic DNA
cggtgtagatgcacagcttctc

SEQ ID NO: 289 - DNA, 27 bp, Artificial Sequence
  Synthetic DNA
cctctgtgctacagattatacctttgc

SEQ ID NO: 290 - DNA, 22 bp, Artificial Sequence
  Synthetic DNA
tacccgccatccatgatcgcca

SEQ ID NO: 291 - DNA, 18 bp, Artificial Sequence
  Synthetic DNA
cactgcagccccaatgct

SEQ ID NO: 292 - DNA, 24 bp, Artificial Sequence
  Synthetic DNA
aaagaagatgatgaccgggtttac

SEQ ID NO: 293 - DNA, 24 bp, Artificial Sequence
  Synthetic DNA
caaactcaacgtgcaagcctcgga

SEQ ID NO: 294 - DNA, 20 bp, Artificial Sequence
  Synthetic DNA
gagcctctggatggtgcaat

SEQ ID NO: 295 - DNA, 25 bp, Artificial Sequence
  Synthetic DNA
ggtcaccaagaaacatcagtatgaa

SEQ ID NO: 296 - DNA, 30 bp, Artificial Sequence
  Synthetic DNA
cccagataatacaggtggccaacaattcct

SEQ ID NO: 297 - DNA, 25 bp, Artificial Sequence
  Synthetic DNA
ttcaatgataatgcaaggactgatc

SEQ ID NO: 298 - DNA, 22 bp, Artificial Sequence
  Synthetic DNA
atgctgtggctccttcctaact

SEQ ID NO: 299 - DNA, 30 bp, Artificial Sequence
  Synthetic DNA
taccaagcaacctacatgtcaagaaagccc

SEQ ID NO: 300 - DNA, 26 bp, Artificial Sequence
  Synthetic DNA
acccaaattgtgatatacaaaaaggt

SEQ ID NO: 301 - DNA, 20 bp, Artificial Sequence
  Synthetic DNA
ggatgacatgcactcagctc

SEQ ID NO: 302 - DNA, 21 bp, Artificial Sequence
  Synthetic DNA
ctcccatcccagtggagccaa

SEQ ID NO: 303 - DNA, 20 bp, Artificial Sequence
  Synthetic DNA
cctgacatttcccttgtcct

SEQ ID NO: 304 - DNA, 24 bp, Artificial Sequence
  Synthetic DNA
gcaggtgtcagcaagtatgatcag

SEQ ID NO: 305 - DNA, 27 bp, Artificial Sequence
  Synthetic DNA
cgacaggatattgaccaccgcctcatt

SEQ ID NO: 306 - DNA, 20 bp, Artificial Sequence
  Synthetic DNA
tttttccgctgtggtgatga

SEQ ID NO: 307 - DNA, 18 bp, Artificial Sequence
  Synthetic DNA
gcccagtgcggagaacag

SEQ ID NO: 308 - DNA, 30 bp, Artificial Sequence
  Synthetic DNA
ccagcttgattctcgtctctgcacttaagc

SEQ ID NO: 309 - DNA, 21 bp, Artificial Sequence
  Synthetic DNA
aatcacacgcacctggagaac

SEQ ID NO: 310 - DNA, 20 bp, Artificial Sequence
  Synthetic DNA
cgtcaggacccaccatgtct

SEQ ID NO: 311 - DNA, 20 bp, Artificial Sequence
  Synthetic DNA
cgcggccgagacatggcttg

SEQ ID NO: 312 - DNA, 24 bp, Artificial Sequence
  Synthetic DNA
ggttaattggtgacatcctcaaga

SEQ ID NO: 313 - DNA, 21 bp, Artificial Sequence
  Synthetic DNA
tccaactaatgccaccaccaa

SEQ ID NO: 314 - DNA, 23 bp, Artificial Sequence
  Synthetic DNA
ctgttgactgcagggcaccacca

SEQ ID NO: 315 - DNA, 25 bp, Artificial Sequence
  Synthetic DNA
gagagagtgagaccacgaagagact

SEQ ID NO: 316 - DNA, 21 bp, Artificial Sequence
  Synthetic DNA
tgtgaaagggaaacacctttg

SEQ ID NO: 317 - DNA, 24 bp, Artificial Sequence
  Synthetic DNA
ccaagtcccctatttcccggacct

SEQ ID NO: 318 - DNA, 19 bp, Artificial Sequence
  Synthetic DNA
agcacccaaaagggcttag

SEQ ID NO: 319 - DNA, 25 bp, Artificial Sequence
  Synthetic DNA
tgtatttcaagacctctgtgcactt

SEQ ID NO: 320 - DNA, 25 bp, Artificial Sequence
  Synthetic DNA
tttatgaacctgccctgctcccaca

SEQ ID NO: 321 - DNA, 23 bp, Artificial Sequence
  Synthetic DNA
ttagcctgaggaattgctgtgtt

SEQ ID NO: 322 - DNA, 19 bp, Artificial Sequence
  Synthetic DNA
ccactgcacacacctcaga

SEQ ID NO: 323 - DNA, 24 bp, Artificial Sequence
  Synthetic DNA
ctgttcttggggccctacaccttg

SEQ ID NO: 324 - DNA, 19 bp, Artificial Sequence
  Synthetic DNA
caggagtttacctgcccct

SEQ ID NO: 325 - DNA, 20 bp, Artificial Sequence
  Synthetic DNA
agatgaagtggaaggcgctt

SEQ ID NO: 326 - DNA, 18 bp, Artificial Sequence
  Synthetic DNA
caccgcggccatcctgca

SEQ ID NO: 327 - DNA, 21 bp, Artificial Sequence
  Synthetic DNA
tgcctctgtaatcggcaactg

SEQ ID NO: 328 - DNA, 19 bp, Artificial Sequence
  Synthetic DNA
atcaccgacagcacagaca

SEQ ID NO: 329 - DNA, 27 bp, Artificial Sequence
  Synthetic DNA
ccctgctaccaatatggactccagtca

SEQ ID NO: 330 - DNA, 20 bp, Artificial Sequence
  Synthetic DNA
acctgtgtttggatttgcag

SEQ ID NO: 331 - DNA, 20 bp, Artificial Sequence
  Synthetic DNA
gacgaagacagtccctggat

SEQ ID NO: 332 - DNA, 24 bp, Artificial Sequence
  Synthetic DNA
caccgacagcacagacagaatccc

SEQ ID NO: 333 - DNA, 20 bp, Artificial Sequence
  Synthetic DNA
actggggtggaatgtgtctt

SEQ ID NO: 334 - DNA, 22 bp, Artificial Sequence
  Synthetic DNA
cacacaaaacagaaccaggact

SEQ ID NO: 335 - DNA, 23 bp, Artificial Sequence
  Synthetic DNA
acccagtggaacccaagccattc

SEQ ID NO: 336 - DNA, 21 bp, Artificial Sequence
  Synthetic DNA
ctgaagtagcacttccggatt

SEQ ID NO: 337 - DNA, 20 bp, Artificial Sequence
  Synthetic DNA
ctcataccagccatccaatg

SEQ ID NO: 338 - DNA, 24 bp, Artificial Sequence
  Synthetic DNA
caccaagcccagaggacagttcct

SEQ ID NO: 339 - DNA, 21 bp, Artificial Sequence
  Synthetic DNA
ttgggttgaagaaatcagtcc

SEQ ID NO: 340 - DNA, 18 bp, Artificial Sequence
  Synthetic DNA
tggttcccagccctgtgt

SEQ ID NO: 341 - DNA, 28 bp, Artificial Sequence
  Synthetic DNA
ctccaagcccagattcagattcgagtca

SEQ ID NO: 342 - DNA, 19 bp, Artificial Sequence
  Synthetic DNA
ctcctccaccctgggttgt

SEQ ID NO: 343 - DNA, 20 bp, Artificial Sequence
  Synthetic DNA
ttcagttgctttgcaggaag

SEQ ID NO: 344 - DNA, 28 bp, Artificial Sequence
  Synthetic DNA
ttctgtgcccaccatattcctctagaca

SEQ ID NO: 345 - DNA, 20 bp, Artificial Sequence
  Synthetic DNA
ttgatcaaggtcaccagagc

SEQ ID NO: 346 - DNA, 20 bp, Artificial Sequence
  Synthetic DNA
gtgcaggctcaggtgaagtg

SEQ ID NO: 347 - DNA, 30 bp, Artificial Sequence
  Synthetic DNA
tcagcttctacaactggacagacaacgctg

SEQ ID NO: 348 - DNA, 20 bp, Artificial Sequence
  Synthetic DNA
gacctcagggcgattcatga

SEQ ID NO: 349 - DNA, 20 bp, Artificial Sequence
  Synthetic DNA
agggtgaggtgcttgagtct

SEQ ID NO: 350 - DNA, 26 bp, Artificial Sequence
  Synthetic DNA
ccaacggcaagggaacaagtacttct

SEQ ID NO: 351 - DNA, 19 bp, Artificial Sequence
  Synthetic DNA
gggcacagtatcccaggta

SEQ ID NO: 352 - DNA, 20 bp, Artificial Sequence
  Synthetic DNA
gggcgtggaacagtttatct

SEQ ID NO: 353 - DNA, 24 bp, Artificial Sequence
  Synthetic DNA
agacatctgccccaagaaggacgt

SEQ ID NO: 354 - DNA, 19 bp, Artificial Sequence
  Synthetic DNA
cacggtgaaggtttcgagt

SEQ ID NO: 355 - DNA, 18 bp, Artificial Sequence
  Synthetic DNA
gagagcgacgcggttgtt

SEQ ID NO: 356 - DNA, 18 bp, Artificial Sequence
  Synthetic DNA
tagctgccgctgcggccg

SEQ ID NO: 357 - DNA, 26 bp, Artificial Sequence
  Synthetic DNA
gtatggtagatcccggcttattattc

SEQ ID NO: 358 - DNA, 21 bp, Artificial Sequence
  Synthetic DNA
tggattggagttctgggaatg

SEQ ID NO: 359 - DNA, 23 bp, Artificial Sequence
  Synthetic DNA
actggccgtggcactggacaaca

SEQ ID NO: 360 - DNA, 22 bp, Artificial Sequence
  Synthetic DNA
gcttgcactccacaggtacaca

SEQ ID NO: 361 - DNA, 20 bp, Artificial Sequence
  Synthetic DNA
tcttgctggctacgcctctt

SEQ ID NO: 362 - DNA, 28 bp, Artificial Sequence
  Synthetic DNA
tgtccctgttagacgtcctccgtccata

SEQ ID NO: 363 - DNA, 21 bp, Artificial Sequence
  Synthetic DNA
ctgcattgtggcacagttctg

SEQ ID NO: 364 - DNA, 21 bp, Artificial Sequence
  Synthetic DNA
aaacgagcagtttgccatcag

SEQ ID NO: 365 - DNA, 24 bp, Artificial Sequence
  Synthetic DNA
cctcaccggcatagactggaagcg

SEQ ID NO: 366 - DNA, 20 bp, Artificial Sequence
  Synthetic DNA
gttggtgatgttccgaagca

SEQ ID NO: 367 - DNA, 20 bp, Artificial Sequence
  Synthetic DNA
ggtgagcagaagtggcctat

SEQ ID NO: 368 - DNA, 23 bp, Artificial Sequence
  Synthetic DNA
ctccccgtcgatgccagagaact

SEQ ID NO: 369 - DNA, 20 bp, Artificial Sequence
  Synthetic DNA
cttcagtcttggcctgttca

SEQ ID NO: 370 - DNA, 18 bp, Artificial Sequence
  Synthetic DNA
gcagtccgctgtgttcaa

SEQ ID NO: 371 - DNA, 24 bp, Artificial Sequence
  Synthetic DNA
tgctccactaacaaccctcctgcc

SEQ ID NO: 372 - DNA, 22 bp, Artificial Sequence
  Synthetic DNA
ggatcccacacctttaccataa

SEQ ID NO: 373 - DNA, 18 bp, Artificial Sequence
  Synthetic DNA
tccagagactgctgaaaa

SEQ ID NO: 374 - DNA, 23 bp, Artificial Sequence
  Synthetic DNA
cccgtgacctgaaggctgtcaag

SEQ ID NO: 375 - DNA, 18 bp, Artificial Sequence
  Synthetic DNA
tgtgtaagtgcagaacac

SEQ ID NO: 376 - DNA, 20 bp, Artificial Sequence
  Synthetic DNA
gagctgaaagacgcacactg

SEQ ID NO: 377 - DNA, 24 bp, Artificial Sequence
  Synthetic DNA
aattcctgcatggccagtttcctc

SEQ ID NO: 378 - DNA, 18 bp, Artificial Sequence
  Synthetic DNA
gccgctcattgatctcca

SEQ ID NO: 379 - DNA, 21 bp, Artificial Sequence
  Synthetic DNA
gcaacactccccatttacctc

SEQ ID NO: 380 - DNA, 24 bp, Artificial Sequence
  Synthetic DNA
ttgttctccaccaaagcaaggcaa

SEQ ID NO: 381 - DNA, 20 bp, Artificial Sequence
  Synthetic DNA
tgagggggaccattctcttt

SEQ ID NO: 382 - DNA, 20 bp, Artificial Sequence
  Synthetic DNA
aagaccgtggatggctacat

SEQ ID NO: 383 - DNA, 24 bp, Artificial Sequence
  Synthetic DNA
atgaagatgacctgcccagaagcc

SEQ ID NO: 384 - DNA, 19 bp, Artificial Sequence
  Synthetic DNA
agggtcacggatgatctgg

SEQ ID NO: 385 - DNA, 21 bp, Artificial Sequence
  Synthetic DNA
tgagtgtcccccggtatcttc

SEQ ID NO: 386 - DNA, 27 bp, Artificial Sequence
  Synthetic DNA
tgccaatcccgatgaaattggaaattt

SEQ ID NO: 387 - DNA, 21 bp, Artificial Sequence
  Synthetic DNA
cagccgctttcagattttcat

SEQ ID NO: 388 - DNA, 18 bp, Artificial Sequence
  Synthetic DNA
gtcggcagaagcaggact

SEQ ID NO: 389 - DNA, 24 bp, Artificial Sequence
  Synthetic DNA
ccttctgcccatagtgatcagcga

SEQ ID NO: 390 - DNA, 18 bp, Artificial Sequence
  Synthetic DNA
ctactcatgggcgggatg

SEQ ID NO: 391 - DNA, 18 bp, Artificial Sequence
  Synthetic DNA
acccatgtaccgtcctcg

SEQ ID NO: 392 - DNA, 24 bp, Artificial Sequence
  Synthetic DNA
ccaacccagatgaaatcggcaact

SEQ ID NO: 393 - DNA, 19 bp, Artificial Sequence
  Synthetic DNA
ccgccttcaggttctcaat

SEQ ID NO: 394 - DNA, 20 bp, Artificial Sequence
  Synthetic DNA
aatgctgcactacgacccta

SEQ ID NO: 395 - DNA, 21 bp, Artificial Sequence
  Synthetic DNA
ccttggccgaaatccgcttgt

SEQ ID NO: 396 - DNA, 20 bp, Artificial Sequence
  Synthetic DNA
ttggtcacatcctggaagaa

SEQ ID NO: 397 - DNA, 18 bp, Artificial Sequence
  Synthetic DNA
agcaacaccagcctcctg

SEQ ID NO: 398 - DNA, 24 bp, Artificial Sequence
  Synthetic DNA
cacctcctctccaatgcctgtgaa

SEQ ID NO: 399 - DNA, 20 bp, Artificial Sequence
  Synthetic DNA
gggctatggcagaaactcct

SEQ ID NO: 400 - DNA, 18 bp, Artificial Sequence
  Synthetic DNA
gggcaggcaaggtttaca

SEQ ID NO: 401 - DNA, 24 bp, Artificial Sequence
  Synthetic DNA
atcttagctgcctttggcttccgc

SEQ ID NO: 402 - DNA, 22 bp, Artificial Sequence
  Synthetic DNA
gtctttggtcagtccagctttc

SEQ ID NO: 403 - DNA, 22 bp, Artificial Sequence
  Synthetic DNA
acttgcctgttcagagcactca

SEQ ID NO: 404 - DNA, 23 bp, Artificial Sequence
  Synthetic DNA
tccttcccacccccagtcctgtc

SEQ ID NO: 405 - DNA, 22 bp, Artificial Sequence
  Synthetic DNA
tggcaaatccgaattagagtga

SEQ ID NO: 406 - DNA, 24 bp, Artificial Sequence
  Synthetic DNA
cacagcctcacttctaaccttctg

SEQ ID NO: 407 - DNA, 23 bp, Artificial Sequence
  Synthetic DNA
acccacccaccactgccaagctc

SEQ ID NO: 408 - DNA, 22 bp, Artificial Sequence
  Synthetic DNA
ttgaatggcgtggattcaatag

SEQ ID NO: 409 - DNA, 20 bp, Artificial Sequence
  Synthetic DNA
gcaacccacgtgtaactgtc

SEQ ID NO: 410 - DNA, 23 bp, Artificial Sequence
  Synthetic DNA
ccgggccctgagtaatcgcttaa

SEQ ID NO: 411 - DNA, 20 bp, Artificial Sequence
  Synthetic DNA
acaagcccgtaggaacatct

SEQ ID NO: 412 - DNA, 21 bp, Artificial Sequence
  Synthetic DNA
tgacaatcagcacacctgcat

SEQ ID NO: 413 - DNA, 20 bp, Artificial Sequence
  Synthetic DNA
caggccctcttccgagcggt

SEQ ID NO: 414 - DNA, 23 bp, Artificial Sequence
  Synthetic DNA
tgtgactacagccgtgatcctta

SEQ ID NO: 415 - DNA, 21 bp, Artificial Sequence
  Synthetic DNA
taaattcactcgtggtgtgga

SEQ ID NO: 416 - DNA, 21 bp, Artificial Sequence
  Synthetic DNA
cttcaattggcaagcccaggc

SEQ ID NO: 417 - DNA, 20 bp, Artificial Sequence
  Synthetic DNA
gcctcttgtagggccaatag

SEQ ID NO: 418 - DNA, 20 bp, Artificial Sequence
  Synthetic DNA
ggatgctggtgacctcttct

SEQ ID NO: 419 - DNA, 25 bp, Artificial Sequence
  Synthetic DNA
tccctcacgttgcaacaggaattaa

SEQ ID NO: 420 - DNA, 20 bp, Artificial Sequence
  Synthetic DNA
gccaaggcaccaagtaactc

SEQ ID NO: 421 - DNA, 18 bp, Artificial Sequence
  Synthetic DNA
ctcccgtcaacagcgttc

SEQ ID NO: 422 - DNA, 24 bp, Artificial Sequence
  Synthetic DNA
acactggaccaggagtgcatccag

SEQ ID NO: 423 - DNA, 18 bp, Artificial Sequence
  Synthetic DNA
gggtgagtctggccttca

SEQ ID NO: 424 - DNA, 20 bp, Artificial Sequence
  Synthetic DNA
actttgcgagaaatgggaac

SEQ ID NO: 425 - DNA, 22 bp, Artificial Sequence
  Synthetic DNA
agtgtggcagaccctcgccatt

SEQ ID NO: 426 - DNA, 20 bp, Artificial Sequence
  Synthetic DNA
caggtattgctcctcctggt

SEQ ID NO: 427 - DNA, 20 bp, Artificial Sequence
  Synthetic DNA
ctgaaggagctccaagacct

SEQ ID NO: 428 - DNA, 22 bp, Artificial Sequence
  Synthetic DNA
tgctgatgtgccctctccttgg

SEQ ID NO: 429 - DNA, 20 bp, Artificial Sequence
  Synthetic DNA
caaaaccgctgtgtttcttc

SEQ ID NO: 430 - DNA, 18 bp, Artificial Sequence
  Synthetic DNA
ccaccataggcagaggca

SEQ ID NO: 431 - DNA, 24 bp, Artificial Sequence
  Synthetic DNA
acaccctactccctgtgcctccag

SEQ ID NO: 432 - DNA, 20 bp, Artificial Sequence
  Synthetic DNA
agtcgtcgagtgctagggac

SEQ ID NO: 433 - DNA, 20 bp, Artificial Sequence
  Synthetic DNA
gaggccagtggtggaaacag

SEQ ID NO: 434 - DNA, 26 bp, Artificial Sequence
  Synthetic DNA
agctgatgagtctgccctaccgcctg

SEQ ID NO: 435 - DNA, 18 bp, Artificial Sequence
  Synthetic DNA
tccgaggccacagcaaac

SEQ ID NO: 436 - DNA, 18 bp, Artificial Sequence
  Synthetic DNA
ctctgtgcgaggctgtca

SEQ ID NO: 437 - DNA, 24 bp, Artificial Sequence
  Synthetic DNA
acccatctcgggatccctgatacc

SEQ ID NO: 438 - DNA, 19 bp, Artificial Sequence
  Synthetic DNA
ggtaaggactgtgggctgg

SEQ ID NO: 439 - DNA, 20 bp, Artificial Sequence
  Synthetic DNA
aaggaagtggtccctctgtg

SEQ ID NO: 440 - DNA, 24 bp, Artificial Sequence
  Synthetic DNA
tgaagtctccagctttgcctcagc

SEQ ID NO: 441 - DNA, 20 bp, Artificial Sequence
  Synthetic DNA
gacgcagtctttctgtctgg

SEQ ID NO: 442 - DNA, 26 bp, Artificial Sequence
  Synthetic DNA
gataaattggtacaagggatcagctt

SEQ ID NO: 443 - DNA, 26 bp, Artificial Sequence
  Synthetic DNA
ccagcccacatgtcctgatcatatgc

SEQ ID NO: 444 - DNA, 24 bp, Artificial Sequence
  Synthetic DNA
gggtgccaagtaactgactattca

SEQ ID NO: 445 - DNA, 21 bp, Artificial Sequence
  Synthetic DNA
atgtggaacccccacctactt

SEQ ID NO: 446 - DNA, 29 bp, Artificial Sequence
  Synthetic DNA
agtcccaacagaaacaagaacttcaggcg

SEQ ID NO: 447 - DNA, 22 bp, Artificial Sequence
  Synthetic DNA
cagtccacagcacggttatacc

SEQ ID NO: 448 - DNA, 18 bp, Artificial Sequence
  Synthetic DNA
tgcctgtggtgggaagct

SEQ ID NO: 449 - DNA, 30 bp, Artificial Sequence
  Synthetic DNA
tgacatagcatcatcctttggttcccagtt

SEQ ID NO: 450 - DNA, 19 bp, Artificial Sequence
  Synthetic DNA
ggaaaatgcctccggtgtt

SEQ ID NO: 451 - DNA, 24 bp, Artificial Sequence
  Synthetic DNA
ggatatttccgtggctcttattca

SEQ ID NO: 452 - DNA, 30 bp, Artificial Sequence
  Synthetic DNA
tctccatcaaatcctgtaaactccagagca

SEQ ID NO: 453 - DNA, 25 bp, Artificial Sequence
  Synthetic DNA
cttctcatcaaggcagaaaaatctt

SEQ ID NO: 454 - DNA, 20 bp, Artificial Sequence
  Synthetic DNA
ggtccctaaaacccatctga

SEQ ID NO: 455 - DNA, 24 bp, Artificial Sequence
  Synthetic DNA
tgaacgccaagattcctccattca

SEQ ID NO: 456 - DNA, 20 bp, Artificial Sequence
  Synthetic DNA
taatggacccatccctgact

SEQ ID NO: 457 - DNA, 20 bp, Artificial Sequence
  Synthetic DNA
ggctggacgtggttttgtct

SEQ ID NO: 458 - DNA, 18 bp, Artificial Sequence
  Synthetic DNA
ctgcgcccgctcttcgcg

SEQ ID NO: 459 - DNA, 20 bp, Artificial Sequence
  Synthetic DNA
cgctgcagaaaatgaaacga

SEQ ID NO: 460 - DNA, 19 bp, Artificial Sequence
  Synthetic DNA
ggctgctttgctgcaactg

SEQ ID NO: 461 - DNA, 24 bp, Artificial Sequence
  Synthetic DNA
cgcacagacaagccttactccgcc

SEQ ID NO: 462 - DNA, 19 bp, Artificial Sequence
  Synthetic DNA
cagagcgggcagcagaata

SEQ ID NO: 463 - DNA, 19 bp, Artificial Sequence
  Synthetic DNA
tctgggaggtgccctactt

SEQ ID NO: 464 - DNA, 24 bp, Artificial Sequence
  Synthetic DNA
tgttcctgtccccgaaaaacaacc

SEQ ID NO: 465 - DNA, 19 bp, Artificial Sequence
  Synthetic DNA
tggatagggccttggtgtt

SEQ ID NO: 466 - DNA, 20 bp, Artificial Sequence
  Synthetic DNA
ggtctgccctagtcatcctg

SEQ ID NO: 467 - DNA, 24 bp, Artificial Sequence
  Synthetic DNA
tgcactgctctcctgttcctgtcc

SEQ ID NO: 468 - DNA, 20 bp, Artificial Sequence
  Synthetic DNA
gtacccagccttgctctcat

SEQ ID NO: 469 - DNA, 20 bp, Artificial Sequence
  Synthetic DNA
cggtacttgagcaatgccta

SEQ ID NO: 470 - DNA, 23 bp, Artificial Sequence
  Synthetic DNA
cgggaagaattcgcttccacctg

SEQ ID NO: 471 - DNA, 20 bp, Artificial Sequence
  Synthetic DNA
tcgatctcctcatcatctgg

SEQ ID NO: 472 - DNA, 19 bp, Artificial Sequence
  Synthetic DNA
accgtatggacagccacag

SEQ ID NO: 473 - DNA, 24 bp, Artificial Sequence
  Synthetic DNA
tctcacatgctgtacccaaagcca

SEQ ID NO: 474 - DNA, 21 bp, Artificial Sequence
  Synthetic DNA
tgactacaggatcagcgcttc

SEQ ID NO: 475 - DNA, 23 bp, Artificial Sequence
  Synthetic DNA
ccccaggatacctaccactacct

SEQ ID NO: 476 - DNA, 20 bp, Artificial Sequence
  Synthetic DNA
cccttcagcctgccccaccg

SEQ ID NO: 477 - DNA, 18 bp, Artificial Sequence
  Synthetic DNA
tgcgggacttgggaaaga

SEQ ID NO: 478 - DNA, 22 bp, Artificial Sequence
  Synthetic DNA
gacatttccagtcctgcagtca

SEQ ID NO: 479 - DNA, 23 bp, Artificial Sequence
  Synthetic DNA
tgcctctctgccccaccctttgt

SEQ ID NO: 480 - DNA, 20 bp, Artificial Sequence
  Synthetic DNA
ctccgatcgcacacatttgt

SEQ ID NO: 481 - DNA, 21 bp, Artificial Sequence
  Synthetic DNA
tccctccactcggaaggacta

SEQ ID NO: 482 - DNA, 27 bp, Artificial Sequence
  Synthetic DNA
tctgacactgtccaacttgaccctctt

SEQ ID NO: 483 - DNA, 22 bp, Artificial Sequence
  Synthetic DNA
cggttgttgctgatctgtctca

SEQ ID NO: 484 - DNA, 18 bp, Artificial Sequence
  Synthetic DNA
tccaccctcctggctttg

SEQ ID NO: 485 - DNA, 23 bp, Artificial Sequence
  Synthetic DNA
tcctttcgtcttcgccatgctgg

SEQ ID NO: 486 - DNA, 21 bp, Artificial Sequence
  Synthetic DNA
tcactcccacgttcaccttgt

SEQ ID NO: 487 - DNA, 18 bp, Artificial Sequence
  Synthetic DNA
gtggccatccagctgacc

SEQ ID NO: 488 - DNA, 21 bp, Artificial Sequence
  Synthetic DNA
tcctgcgcctgatgtccaccg

SEQ ID NO: 489 - DNA, 23 bp, Artificial Sequence
  Synthetic DNA
cagtggtaggtgatgttctggga

SEQ ID NO: 490 - DNA, 24 bp, Artificial Sequence
  Synthetic DNA
cagccaagaactggtataggagct

SEQ ID NO: 491 - DNA, 30 bp, Artificial Sequence
  Synthetic DNA
tctcctagccagacgtgtttcttgtccttg

SEQ ID NO: 492 - DNA, 19 bp, Artificial Sequence
  Synthetic DNA
aaactggctgccagcattg

SEQ ID NO: 493 - DNA, 20 bp, Artificial Sequence
  Synthetic DNA
atgcccagtgttcctgactt

SEQ ID NO: 494 - DNA, 26 bp, Artificial Sequence
  Synthetic DNA
cgaaacgctattctcacaggttcagc

SEQ ID NO: 495 - DNA, 20 bp, Artificial Sequence
  Synthetic DNA
ctccccattacaagtgctga

SEQ ID NO: 496 - DNA, 23 bp, Artificial Sequence
  Synthetic DNA
tctgcagagttggaagcactcta

SEQ ID NO: 497 - DNA, 28 bp, Artificial Sequence
  Synthetic DNA
caggatacagctccacagcatcgatgtc

SEQ ID NO: 498 - DNA, 21 bp, Artificial Sequence
  Synthetic DNA
gccgaggcttttctaccagaa

SEQ ID NO: 499 - DNA, 20 bp, Artificial Sequence
  Synthetic DNA
tcgagtctcccttcaccatt

SEQ ID NO: 500 - DNA, 23 bp, Artificial Sequence
  Synthetic DNA
cgacggcatctacggctcaacat

SEQ ID NO: 501 - DNA, 19 bp, Artificial Sequence
  Synthetic DNA
gacgtgaagtccgtggaag

SEQ ID NO: 502 - DNA, 21 bp, Artificial Sequence
  Synthetic DNA
cgtgagtacacagatgcctcc

SEQ ID NO: 503 - DNA, 24 bp, Artificial Sequence
  Synthetic DNA
tcttcagggcctctctcctttcga

SEQ ID NO: 504 - DNA, 18 bp, Artificial Sequence
  Synthetic DNA
ccaggatgccaagatgct

SEQ ID NO: 505 - DNA, 23 bp, Artificial Sequence
  Synthetic DNA
tggtctgcaagcaagtattcaag

SEQ ID NO: 506 - DNA, 23 bp, Artificial Sequence
  Synthetic DNA
tctgcttgggcctcactgcacct

SEQ ID NO: 507 - DNA, 21 bp, Artificial Sequence
  Synthetic DNA
gctgattggttgggacaaggt

SEQ ID NO: 508 - DNA, 21 bp, Artificial Sequence
  Synthetic DNA
tgggaagcagctgtgtaccat

SEQ ID NO: 509 - DNA, 28 bp, Artificial Sequence
  Synthetic DNA
cctcgcgatgctgcctactacagctatc

SEQ ID NO: 510 - DNA, 30 bp, Artificial Sequence
  Synthetic DNA
gaaacacttctcacagaaatgatacctatt

SEQ ID NO: 511 - DNA, 18 bp, Artificial Sequence
  Synthetic DNA
gtgctacgccaccctgtt

SEQ ID NO: 512 - DNA, 22 bp, Artificial Sequence
  Synthetic DNA
ccgatgttcacgcctttgggtc

SEQ ID NO: 513 - DNA, 20 bp, Artificial Sequence
  Synthetic DNA
caggggcttctcgtagatgt

SEQ ID NO: 514 - DNA, 18 bp, Artificial Sequence
  Synthetic DNA
gggtctgtgccccatgac

SEQ ID NO: 515 - DNA, 25 bp, Artificial Sequence
  Synthetic DNA
cctggctgcccaagaagtgttccct

SEQ ID NO: 516 - DNA, 20 bp, Artificial Sequence
  Synthetic DNA
tgaccgtgccagcatttaca

SEQ ID NO: 517 - DNA, 20 bp, Artificial Sequence
  Synthetic DNA
ctccctaacctccagaatgg

SEQ ID NO: 518 - DNA, 24 bp, Artificial Sequence
  Synthetic DNA
actcgcttctggataaccctggca

SEQ ID NO: 519 - DNA, 20 bp, Artificial Sequence
  Synthetic DNA
tgtcttgtcgtaggcattgg

SEQ ID NO: 520 - DNA, 20 bp, Artificial Sequence
  Synthetic DNA
aaggtttttggattgcaagg

SEQ ID NO: 521 - DNA, 24 bp, Artificial Sequence
  Synthetic DNA
accgtcatacatgcccctggaaac

SEQ ID NO: 522 - DNA, 20 bp, Artificial Sequence
  Synthetic DNA
gggtgtagctggtacctcgt

SEQ ID NO: 523 - DNA, 20 bp, Artificial Sequence
  Synthetic DNA
gatgtgattgaggtgcatgg

SEQ ID NO: 524 - DNA, 24 bp, Artificial Sequence
  Synthetic DNA
tgttcatcctggcgctcttcatgt

SEQ ID NO: 525 - DNA, 21 bp, Artificial Sequence
  Synthetic DNA
gaactccctggagatgaaacc

SEQ ID NO: 526 - DNA, 20 bp, Artificial Sequence
  Synthetic DNA
ttacgcagctcatgctcttg

SEQ ID NO: 527 - DNA, 24 bp, Artificial Sequence
  Synthetic DNA
acggctctttactatgcgagggcc

SEQ ID NO: 528 - DNA, 22 bp, Artificial Sequence
  Synthetic DNA
gcagctgtaaagagagtggcat

SEQ ID NO: 529 - DNA, 18 bp, Artificial Sequence
  Synthetic DNA
tgcagcggctgattgaca

SEQ ID NO: 530 - DNA, 28 bp, Artificial Sequence
  Synthetic DNA
tcagatggagacctcgtgccaaattaca

SEQ ID NO: 531 - DNA, 25 bp, Artificial Sequence
  Synthetic DNA
caactgttcctggtctacaaactca

SEQ ID NO: 532 - DNA, 20 bp, Artificial Sequence
  Synthetic DNA
cctgaacatgaaggagctga

SEQ ID NO: 533 - DNA, 21 bp, Artificial Sequence
  Synthetic DNA
tcccgatggtctgcagcagct

SEQ ID NO: 534 - DNA, 19 bp, Artificial Sequence
  Synthetic DNA
catcacgtctccgaactcc

SEQ ID NO: 535 - DNA, 20 bp, Artificial Sequence
  Synthetic DNA
gctctccatcagctcctgtc

SEQ ID NO: 536 - DNA, 24 bp, Artificial Sequence
  Synthetic DNA
ccacatcaacagggaaagctgctg

SEQ ID NO: 537 - DNA, 19 bp, Artificial Sequence
  Synthetic DNA
aacacgggcagaaagcact

SEQ ID NO: 538 - DNA, 19 bp, Artificial Sequence
  Synthetic DNA
gagttcaagtgccctgacg

SEQ ID NO: 539 - DNA, 28 bp, Artificial Sequence
  Synthetic DNA
aacatcatgttcttcttcatgacctcgc

SEQ ID NO: 540 - DNA, 20 bp, Artificial Sequence
  Synthetic DNA
agttgtaatggcaggcacag

SEQ ID NO: 541 - DNA, 20 bp, Artificial Sequence
  Synthetic DNA
gctcacttcggctaaaatgc

SEQ ID NO: 542 - DNA, 24 bp, Artificial Sequence
  Synthetic DNA
accaacgctgacagcatgcatttc

SEQ ID NO: 543 - DNA, 21 bp, Artificial Sequence
  Synthetic DNA
tcagctccattgaatgtgaaa

SEQ ID NO: 544 - DNA, 19 bp, Artificial Sequence
  Synthetic DNA
cactgaggtccgggtgaca

SEQ ID NO: 545 - DNA, 21 bp, Artificial Sequence
  Synthetic DNA
cacctggctgtcagcctgccg

SEQ ID NO: 546 - DNA, 21 bp, Artificial Sequence
  Synthetic DNA
gtaggttgccgcacagacttc

SEQ ID NO: 547 - DNA, 19 bp, Artificial Sequence
  Synthetic DNA
gttttccaggtcggagacg

SEQ ID NO: 548 - DNA, 24 bp, Artificial Sequence
  Synthetic DNA
ctttgcagctactgcctccggtct

SEQ ID NO: 549 - DNA, 18 bp, Artificial Sequence
  Synthetic DNA
agcatccagggtgttcca

SEQ ID NO: 550 - DNA, 20 bp, Artificial Sequence
  Synthetic DNA
ggccgagatctacaaaaacg

SEQ ID NO: 551 - DNA, 21 bp, Artificial Sequence
  Synthetic DNA
ccccgtggagggagctttctc

SEQ ID NO: 552 - DNA, 20 bp, Artificial Sequence
  Synthetic DNA
gcaggaagtccgaatacaca

SEQ ID NO: 553 - DNA, 24 bp, Artificial Sequence
  Synthetic DNA
gtacatgatcccctgtgagaaggt

SEQ ID NO: 554 - DNA, 22 bp, Artificial Sequence
  Synthetic DNA
accctgcccgcgatcacactga

SEQ ID NO: 555 - DNA, 21 bp, Artificial Sequence
  Synthetic DNA
gggacagcttgtagcctttgc

SEQ ID NO: 556 - DNA, 20 bp, Artificial Sequence
  Synthetic DNA
gcaagttccaacctggaaag

SEQ ID NO: 557 - DNA, 24 bp, Artificial Sequence
  Synthetic DNA
tggctacatccttgacaaagccga

SEQ ID NO: 558 - DNA, 20 bp, Artificial Sequence
  Synthetic DNA
catcgcttcctcgtcataga

SEQ ID NO: 559 - DNA, 23 bp, Artificial Sequence
  Synthetic DNA
gggaggcttatctcactgagtga

SEQ ID NO: 560 - DNA, 29 bp, Artificial Sequence
  Synthetic DNA
ttgaggcccagagcagtctaccagattct

SEQ ID NO: 561 - DNA, 19 bp, Artificial Sequence
  Synthetic DNA
ccattgcagccttcattgc

SEQ ID NO: 562 - DNA, 21 bp, Artificial Sequence
  Synthetic DNA
tgtctcactgagcgagcagaa

SEQ ID NO: 563 - DNA, 24 bp, Artificial Sequence
  Synthetic DNA
cttgaggacgcgaacagtccacca

SEQ ID NO: 564 - DNA, 19 bp, Artificial Sequence
  Synthetic DNA
accattgcagccctgattg

SEQ ID NO: 565 - DNA, 21 bp, Artificial Sequence
  Synthetic DNA
atgccctggtaatgtctgcat

SEQ ID NO: 566 - DNA, 24 bp, Artificial Sequence
  Synthetic DNA
cagccacaaagccagcgtcattgt

SEQ ID NO: 567 - DNA, 21 bp, Artificial Sequence
  Synthetic DNA
gcgaccacaagccttatcaag

SEQ ID NO: 568 - DNA, 21 bp, Artificial Sequence
  Synthetic DNA
aagcatcttcctgttcttgga

SEQ ID NO: 569 - DNA, 24 bp, Artificial Sequence
  Synthetic DNA
tatgtgctgcagaactccacgctg

SEQ ID NO: 570 - DNA, 20 bp, Artificial Sequence
  Synthetic DNA
aatcccatatcccagatgga

SEQ ID NO: 571 - DNA, 19 bp, Artificial Sequence
  Synthetic DNA
gagctacagatgcccatgc

SEQ ID NO: 572 - DNA, 24 bp, Artificial Sequence
  Synthetic DNA
ttcttcgaaagccatgttgccaga

SEQ ID NO: 573 - DNA, 20 bp, Artificial Sequence
  Synthetic DNA
tttgagatgcttgacgttgg

SEQ ID NO: 574 - DNA, 20 bp, Artificial Sequence
  Synthetic DNA
tgaccgcttctaccccaatg

SEQ ID NO: 575 - DNA, 28 bp, Artificial Sequence
  Synthetic DNA
ctgaaactggaacacaaccacccacaag

SEQ ID NO: 576 - DNA, 22 bp, Artificial Sequence
  Synthetic DNA
aggataaggccaaccatgatgt

SEQ ID NO: 577 - DNA, 19 bp, Artificial Sequence
  Synthetic DNA
ggtgcctactccattgtgg

SEQ ID NO: 578 - DNA, 24 bp, Artificial Sequence
  Synthetic DNA
tactccagcaggcacacaaacacg

SEQ ID NO: 579 - DNA, 20 bp, Artificial Sequence
  Synthetic DNA
gtggagcccttcttcctctt

SEQ ID NO: 580 - DNA, 22 bp, Artificial Sequence
  Synthetic DNA
ccagctttgtgcctgtcactat

SEQ ID NO: 581 - DNA, 25 bp, Artificial Sequence
  Synthetic DNA
ctcatgccaccactgccaacacctc

SEQ ID NO: 582 - DNA, 20 bp, Artificial Sequence
  Synthetic DNA
gggaatgtggtagcccaaga

SEQ ID NO: 583 - DNA, 20 bp, Artificial Sequence
  Synthetic DNA
ccgtgttcaagaggaagctc

SEQ ID NO: 584 - DNA, 24 bp, Artificial Sequence
  Synthetic DNA
ttttctcaactcctccacaaggca

SEQ ID NO: 585 - DNA, 20 bp, Artificial Sequence
  Synthetic DNA
agtgggatcacagggtgaag

SEQ ID NO: 586 - DNA, 30 bp, Artificial Sequence
  Synthetic DNA
agaacaaggacaacatagatccttacatat

SEQ ID NO: 587 - DNA, 26 bp, Artificial Sequence
  Synthetic DNA
cacaccctttggaagtggacccagaa

SEQ ID NO: 588 - DNA, 19 bp, Artificial Sequence
  Synthetic DNA
gcaaacctcatgccaatgc

SEQ ID NO: 589 - DNA, 20 bp, Artificial Sequence
  Synthetic DNA
tgctcattcttgaggagcat

SEQ ID NO: 590 - DNA, 24 bp, Artificial Sequence
  Synthetic DNA
cagcacccttggcagtttcgaaat

SEQ ID NO: 591 - DNA, 20 bp, Artificial Sequence
  Synthetic DNA
gtggctgcattagtgtccat

SEQ ID NO: 592 - DNA, 22 bp, Artificial Sequence
  Synthetic DNA
cgctgacatcatgaatgttcct

SEQ ID NO: 593 - DNA, 25 bp, Artificial Sequence
  Synthetic DNA
tcatatccaaactcgcctccagccg

SEQ ID NO: 594 - DNA, 24 bp, Artificial Sequence
  Synthetic DNA
tctctttcagcaacgatgtgtctt

SEQ ID NO: 595 - DNA, 20 bp, Artificial Sequence
  Synthetic DNA
aaatgtcctcctcgactgct

SEQ ID NO: 596 - DNA, 24 bp, Artificial Sequence
  Synthetic DNA
atcactggaactcctcggtcggac

SEQ ID NO: 597 - DNA, 20 bp, Artificial Sequence
  Synthetic DNA
tgaatgccatctttcttcca

SEQ ID NO: 598 - DNA, 20 bp, Artificial Sequence
  Synthetic DNA
ggtcaccgttggtgtcatca

SEQ ID NO: 599 - DNA, 26 bp, Artificial Sequence
  Synthetic DNA
cagccacgatgaccactaccagcact

SEQ ID NO: 600 - DNA, 18 bp, Artificial Sequence
  Synthetic DNA
gagcgtcgggtgcaaatc

SEQ ID NO: 601 - DNA, 24 bp, Artificial Sequence
  Synthetic DNA
atggagatgtggtcattcctagtg

SEQ ID NO: 602 - DNA, 26 bp, Artificial Sequence
  Synthetic DNA
tgcttcctcccactatctgaaaataa

SEQ ID NO: 603 - DNA, 22 bp, Artificial Sequence
  Synthetic DNA
caccaccccaagtatccgtaag

SEQ ID NO: 604 - DNA, 21 bp, Artificial Sequence
  Synthetic DNA
gccgccacaagactaaggaat

SEQ ID NO: 605 - DNA, 24 bp, Artificial Sequence
  Synthetic DNA
agctgcccgtctttctcagccagc

SEQ ID NO: 606 - DNA, 20 bp, Artificial Sequence
  Synthetic DNA
cgatgttcccttcgatggag

SEQ ID NO: 607 - DNA, 18 bp, Artificial Sequence
  Synthetic DNA
tgcggatcatccggaatg

SEQ ID NO: 608 - DNA, 25 bp, Artificial Sequence
  Synthetic DNA
aattggaatccacgagcatgccagc

SEQ ID NO: 609 - DNA, 22 bp, Artificial Sequence
  Synthetic DNA
tcctttgatgcctggtaagtca

SEQ ID NO: 610 - DNA, 22 bp, Artificial Sequence
  Synthetic DNA
cttgtggagatcacccaatcag

SEQ ID NO: 611 - DNA, 21 bp, Artificial Sequence
  Synthetic DNA
ctatgcccgggactcgggcct

SEQ ID NO: 612 - DNA, 19 bp, Artificial Sequence
  Synthetic DNA
cccgcctggatctcaaact

SEQ ID NO: 613 - DNA, 27 bp, Artificial Sequence
  Synthetic DNA
ttgctataactaagtgcttctccaaga

SEQ ID NO: 614 - DNA, 22 bp, Artificial Sequence
  Synthetic DNA
cccaactgagtccccagcacct

SEQ ID NO: 615 - DNA, 22 bp, Artificial Sequence
  Synthetic DNA
gtggaatggcagctcactgtag

SEQ ID NO: 616 - DNA, 22 bp, Artificial Sequence
  Synthetic DNA
gggagaacgggatcaataggat

SEQ ID NO: 617 - DNA, 24 bp, Artificial Sequence
  Synthetic DNA
ctcattgggcaccagcaggtttcc

SEQ ID NO: 618 - DNA, 21 bp, Artificial Sequence
  Synthetic DNA
gcatcagccagtcctcaaact

SEQ ID NO: 619 - DNA, 19 bp, Artificial Sequence
  Synthetic DNA
cacaatggcggctctgaag

SEQ ID NO: 620 - DNA, 23 bp, Artificial Sequence
  Synthetic DNA
aagttacgctgcgcgacagccaa

SEQ ID NO: 621 - DNA, 26 bp, Artificial Sequence
  Synthetic DNA
acacaaacactgtctgtacctgaaga

SEQ ID NO: 622 - DNA, 20 bp, Artificial Sequence
  Synthetic DNA
caagcagtcaaggagaacca

SEQ ID NO: 623 - DNA, 22 bp, Artificial Sequence
  Synthetic DNA
ttcttctgtctcccgccgcttc

SEQ ID NO: 624 - DNA, 20 bp, Artificial Sequence
  Synthetic DNA
agttttgctcgcctcatctt

SEQ ID NO: 625 - DNA, 20 bp, Artificial Sequence
  Synthetic DNA
tccaattccagcatcactgt

SEQ ID NO: 626 - DNA, 25 bp, Artificial Sequence
  Synthetic DNA
agaaaagctgtttgtctccccagca

SEQ ID NO: 627 - DNA, 20 bp, Artificial Sequence
  Synthetic DNA
ggcagtgaaggcgataaagt

SEQ ID NO: 628 - DNA, 20 bp, Artificial Sequence
  Synthetic DNA
tgacaactaccagccgtacc

SEQ ID NO: 629 - DNA, 22 bp, Artificial Sequence
  Synthetic DNA
agtgccgcactcctcgtcctct

SEQ ID NO: 630 - DNA, 21 bp, Artificial Sequence
  Synthetic DNA
gggactagcgcagtactcatc

SEQ ID NO: 631 - DNA, 20 bp, Artificial Sequence
  Synthetic DNA
gattcagacgaggatgagcc

SEQ ID NO: 632 - DNA, 24 bp, Artificial Sequence
  Synthetic DNA
aaagtccatttgccactgatggca

SEQ ID NO: 633 - DNA, 20 bp, Artificial Sequence
  Synthetic DNA
cacctcttgctgtccctttg

SEQ ID NO: 634 - DNA, 19 bp, Artificial Sequence
  Synthetic DNA
aggacgcaaggagggtttg

SEQ ID NO: 635 - DNA, 29 bp, Artificial Sequence
  Synthetic DNA
cagtgcctacagtctcgagtctgccagtg

SEQ ID NO: 636 - DNA, 21 bp, Artificial Sequence
  Synthetic DNA
gatgtccgccgagtccttact

SEQ ID NO: 637 - DNA, 21 bp, Artificial Sequence
  Synthetic DNA
tgcacagagggtgtgggttac

SEQ ID NO: 638 - DNA, 29 bp, Artificial Sequence
  Synthetic DNA
caatgcttccaacaatttgtttgcttgcc

SEQ ID NO: 639 - DNA, 28 bp, Artificial Sequence
  Synthetic DNA
tcttcatctgatttacaagctgtacatg

SEQ ID NO: 640 - DNA, 24 bp, Artificial Sequence
  Synthetic DNA
ctctgagacagtgcttcgatgact

SEQ ID NO: 641 - DNA, 23 bp, Artificial Sequence
  Synthetic DNA
cagacttggtgccctttgactcc

SEQ ID NO: 642 - DNA, 19 bp, Artificial Sequence
  Synthetic DNA
ccatgaggcccaacttcct

SEQ ID NO: 643 - DNA, 20 bp, Artificial Sequence
  Synthetic DNA
cctggatctcccaggtatca

SEQ ID NO: 644 - DNA, 24 bp, Artificial Sequence
  Synthetic DNA
acctttcccatccttggcaccttc

SEQ ID NO: 645 - DNA, 20 bp, Artificial Sequence
  Synthetic DNA
tgcaatgacttgacgacctc

SEQ ID NO: 646 - DNA, 22 bp, Artificial Sequence
  Synthetic DNA
tggcactactgcatgattgaca

SEQ ID NO: 647 - DNA, 21 bp, Artificial Sequence
  Synthetic DNA
cagggccatgacaatcgccaa

SEQ ID NO: 648 - DNA, 19 bp, Artificial Sequence
  Synthetic DNA
cctgccgcattgttttcag

SEQ ID NO: 649 - DNA, 19 bp, Artificial Sequence
  Synthetic DNA
aaatcgctgggaacaagtg

SEQ ID NO: 650 - DNA, 24 bp, Artificial Sequence
  Synthetic DNA
cgccctggctcaacttttccttaa

SEQ ID NO: 651 - DNA, 20 bp, Artificial Sequence
  Synthetic DNA
aatgcgtatctgtccacgac

SEQ ID NO: 652 - DNA, 20 bp, Artificial Sequence
  Synthetic DNA
agacatcagctcctggttca

SEQ ID NO: 653 - DNA, 26 bp, Artificial Sequence
  Synthetic DNA
cgaggccattgacttcatagactcca

SEQ ID NO: 654 - DNA, 20 bp, Artificial Sequence
  Synthetic DNA
gacaaacacccttcctccag

SEQ ID NO: 655 - DNA, 20 bp, Artificial Sequence
  Synthetic DNA
tatccctgtggaggacaacc

SEQ ID NO: 656 - DNA, 24 bp, Artificial Sequence
  Synthetic DNA
cctcctggaaccaggcactgatct

SEQ ID NO: 657 - DNA, 20 bp, Artificial Sequence
  Synthetic DNA
cacccagtcaatgaagccta

SEQ ID NO: 658 - DNA, 20 bp, Artificial Sequence
  Synthetic DNA
acacatggagtgcttctgga

SEQ ID NO: 659 - DNA, 24 bp, Artificial Sequence
  Synthetic DNA
atcagcccacttgaccacccagtt

SEQ ID NO: 660 - DNA, 19 bp, Artificial Sequence
  Synthetic DNA
ctcttgcctgtgcttccac

SEQ ID NO: 661 - DNA, 20 bp, Artificial Sequence
  Synthetic DNA
agcatgacacggagatgaag

SEQ ID NO: 662 - DNA, 24 bp, Artificial Sequence
  Synthetic DNA
cacctgaagcggcacttcatgttc

SEQ ID NO: 663 - DNA, 20 bp, Artificial Sequence
  Synthetic DNA
aataccaggcacaggtggtt

SEQ ID NO: 664 - DNA, 20 bp, Artificial Sequence
  Synthetic DNA
actccctctacccttgagca

SEQ ID NO: 665 - DNA, 24 bp, Artificial Sequence
  Synthetic DNA
cagaagaacagctcagggacccct

SEQ ID NO: 666 - DNA, 20 bp, Artificial Sequence
  Synthetic DNA
caggcctcagttccttcagt

SEQ ID NO: 667 - DNA, 20 bp, Artificial Sequence
  Synthetic DNA
tgccacctggacatcatttg

SEQ ID NO: 668 - DNA, 23 bp, Artificial Sequence
  Synthetic DNA
cactcccgagcacgttgttccgt

SEQ ID NO: 669 - DNA, 21 bp, Artificial Sequence
  Synthetic DNA
tggacctagggcttccaagtc

SEQ ID NO: 670 - DNA, 20 bp, Artificial Sequence
  Synthetic DNA
tacatctccaaacccatcca

SEQ ID NO: 671 - DNA, 24 bp, Artificial Sequence
  Synthetic DNA
caacctcaagcagcggtcttcatg

SEQ ID NO: 672 - DNA, 20 bp, Artificial Sequence
  Synthetic DNA
ttgccactgacagtcacctt

SEQ ID NO: 673 - DNA, 20 bp, Artificial Sequence
  Synthetic DNA
actacatctccacgcccact

SEQ ID NO: 674 - DNA, 25 bp, Artificial Sequence
  Synthetic DNA
cctcagacacttccagtgcaggttg

SEQ ID NO: 675 - DNA, 20 bp, Artificial Sequence
  Synthetic DNA
cagcagacgaacaccttcat

SEQ ID NO: 676 - DNA, 18 bp, Artificial Sequence
  Synthetic DNA
ggagcccgtatcctggag

SEQ ID NO: 677 - DNA, 24 bp, Artificial Sequence
  Synthetic DNA
ccctcaaccccaagttcctgagtg

SEQ ID NO: 678 - DNA, 21 bp, Artificial Sequence
  Synthetic DNA
ggatagatcaccaagcccttc

SEQ ID NO: 679 - DNA, 23 bp, Artificial Sequence
  Synthetic DNA
tgacattatcatcccgctaagga

SEQ ID NO: 680 - DNA, 24 bp, Artificial Sequence
  Synthetic DNA
cggacagcgtcttctgccctcact

SEQ ID NO: 681 - DNA, 21 bp, Artificial Sequence
  Synthetic DNA
gtagtccccgctgaccttctc

SEQ ID NO: 682 - DNA, 20 bp, Artificial Sequence
  Synthetic DNA
ttgaacagagcctgaccaag

SEQ ID NO: 683 - DNA, 28 bp, Artificial Sequence
  Synthetic DNA
tgatgctttctccagaaactcgaactca

SEQ ID NO: 684 - DNA, 20 bp, Artificial Sequence
  Synthetic DNA
tgttgagattcctcgcagtt

SEQ ID NO: 685 - DNA, 20 bp, Artificial Sequence
  Synthetic DNA
tgtcgatggacttccagaac

SEQ ID NO: 686 - DNA, 18 bp, Artificial Sequence
  Synthetic DNA
cacctgggcagctgccaa

SEQ ID NO: 687 - DNA, 19 bp, Artificial Sequence
  Synthetic DNA
attgggacagcttggatca

SEQ ID NO: 688 - DNA, 18 bp, Artificial Sequence
  Synthetic DNA
tcaatggccggacgaaag

SEQ ID NO: 689 - DNA, 26 bp, Artificial Sequence
  Synthetic DNA
cattgcccggataacaagcaaccatg

SEQ ID NO: 690 - DNA, 28 bp, Artificial Sequence
  Synthetic DNA
tttggattatcaacatgacgtacataac

SEQ ID NO: 691 - DNA, 18 bp, Artificial Sequence
  Synthetic DNA
gctggtcctctactgcgg

SEQ ID NO: 692 - DNA, 24 bp, Artificial Sequence
  Synthetic DNA
ccggctgggcaaatactacgtcaa

SEQ ID NO: 693 - DNA, 20 bp, Artificial Sequence
  Synthetic DNA
ccaccattgccttagacctc

SEQ ID NO: 694 - DNA, 19 bp, Artificial Sequence
  Synthetic DNA
gtccccgctgcagatctct

SEQ ID NO: 695 - DNA, 23 bp, Artificial Sequence
  Synthetic DNA
cggatcctttcctcactcgccca

SEQ ID NO: 696 - DNA, 24 bp, Artificial Sequence
  Synthetic DNA
ctccagcttagggtagttgtccat

SEQ ID NO: 697 - DNA, 20 bp, Artificial Sequence
  Synthetic DNA
ccatgtggatgaatgaggtg

SEQ ID NO: 698 - DNA, 24 bp, Artificial Sequence
  Synthetic DNA
acccagtctcaccttctccccacc

SEQ ID NO: 699 - DNA, 20 bp, Artificial Sequence
  Synthetic DNA
tgcctgagaagaggtgaggt

SEQ ID NO: 700 - DNA, 20 bp, Artificial Sequence
  Synthetic DNA
aaagtggtgaatgccatttg

SEQ ID NO: 701 - DNA, 28 bp, Artificial Sequence
  Synthetic DNA
cctcaaatgccaggtcagctatatcctg

SEQ ID NO: 702 - DNA, 20 bp, Artificial Sequence
  Synthetic DNA
gtgaggcttcctccctgata

SEQ ID NO: 703 - DNA, 23 bp, Artificial Sequence
  Synthetic DNA
gatctaagatggcgactgtcgaa

SEQ ID NO: 704 - DNA, 27 bp, Artificial Sequence
  Synthetic DNA
accacccctactcctaatcccccgact

SEQ ID NO: 705 - DNA, 25 bp, Artificial Sequence
  Synthetic DNA
ttagattccgttttctcctcttctg

SEQ ID NO: 706 - DNA, 18 bp, Artificial Sequence
  Synthetic DNA
aagccgcggttgaatgtg

SEQ ID NO: 707 - DNA, 25 bp, Artificial Sequence
  Synthetic DNA
tgaccctctccctctctggatggca

SEQ ID NO: 708 - DNA, 20 bp, Artificial Sequence
  Synthetic DNA
tgacgccagcttcaatgatg

SEQ ID NO: 709 - DNA, 20 bp, Artificial Sequence
  Synthetic DNA
gacaggaggcctctatcctg

SEQ ID NO: 710 - DNA, 22 bp, Artificial Sequence
  Synthetic DNA
caccccaccctccacctcaatc

SEQ ID NO: 711 - DNA, 20 bp, Artificial Sequence
  Synthetic DNA
gtgaggtaggtctggggaag

SEQ ID NO: 712 - DNA, 25 bp, Artificial Sequence
  Synthetic DNA
gctagtactttgatgctcccttgat

SEQ ID NO: 713 - DNA, 22 bp, Artificial Sequence
  Synthetic DNA
ccagagagcctccctgcagcca

SEQ ID NO: 714 - DNA, 20 bp, Artificial Sequence
  Synthetic DNA
gaacagctggaggccaagtc

SEQ ID NO: 715 - DNA, 20 bp, Artificial Sequence
  Synthetic DNA
tggcctacctcttcaccatc

SEQ ID NO: 716 - DNA, 24 bp, Artificial Sequence
  Synthetic DNA
tcaacagcctccaaggcttcttca

SEQ ID NO: 717 - DNA, 21 bp, Artificial Sequence
  Synthetic DNA
tgaggaggcagtagaccaaga

SEQ ID NO: 718 - DNA, 22 bp, Artificial Sequence
  Synthetic DNA
ggcagtgtcactgagtccttga

SEQ ID NO: 719 - DNA, 18 bp, Artificial Sequence
  Synthetic DNA
atcctcccctgccccgcg

SEQ ID NO: 720 - DNA, 18 bp, Artificial Sequence
  Synthetic DNA
tgcactgtgcgtcccaat

SEQ ID NO: 721 - DNA, 20 bp, Artificial Sequence
  Synthetic DNA
caaggccgtgaacgagaagt

SEQ ID NO: 722 - DNA, 26 bp, Artificial Sequence
  Synthetic DNA
ctgcaactgcctcctgctcaaagtca

SEQ ID NO: 723 - DNA, 18 bp, Artificial Sequence
  Synthetic DNA
cggtcacggagccaatct

SEQ ID NO: 724 - DNA, 20 bp, Artificial Sequence
  Synthetic DNA
agccccagcaactacagtct

SEQ ID NO: 725 - DNA, 23 bp, Artificial Sequence
  Synthetic DNA
cactgacatcatggctggccttg

SEQ ID NO: 726 - DNA, 20 bp, Artificial Sequence
  Synthetic DNA
tgttcaaaggttgaccatgc

SEQ ID NO: 727 - DNA, 21 bp, Artificial Sequence
  Synthetic DNA
aagccttggagggtttcattg

SEQ ID NO: 728 - DNA, 23 bp, Artificial Sequence
  Synthetic DNA
tgtcgccatcttgggtcaccacg

SEQ ID NO: 729 - DNA, 25 bp, Artificial Sequence
  Synthetic DNA
tgctgatgttttctgacagaaagat

SEQ ID NO: 730 - DNA, 20 bp, Artificial Sequence
  Synthetic DNA
gggccctccagaacaatgat

SEQ ID NO: 731 - DNA, 25 bp, Artificial Sequence
  Synthetic DNA
ccgctctcatcgcagtcaggatcat

SEQ ID NO: 732 - DNA, 21 bp, Artificial Sequence
  Synthetic DNA
tgcactgcttggccttaaaga

SEQ ID NO: 733 - DNA, 21 bp, Artificial Sequence
  Synthetic DNA
cgcctgttcaccaagattgac

SEQ ID NO: 734 - DNA, 20 bp, Artificial Sequence
  Synthetic DNA
tgcgcccgatgagatcaccg

SEQ ID NO: 735 - DNA, 18 bp, Artificial Sequence
  Synthetic DNA
gtggcgtgcctcgaagtc

SEQ ID NO: 736 - DNA, 18 bp, Artificial Sequence
  Synthetic DNA
caaccaggcagctccatc

SEQ ID NO: 737 - DNA, 24 bp, Artificial Sequence
  Synthetic DNA
cacctgatgcatgatggacactgc

SEQ ID NO: 738 - DNA, 19 bp, Artificial Sequence
  Synthetic DNA
gtaatgctgtccacggtgc

SEQ ID NO: 739 - DNA, 20 bp, Artificial Sequence
  Synthetic DNA
tgaacggggtatcctcctta

SEQ ID NO: 740 - DNA, 24 bp, Artificial Sequence
  Synthetic DNA
cgtcccatttgagcctgtcaatgt

SEQ ID NO: 741 - DNA, 20 bp, Artificial Sequence
  Synthetic DNA
aggtacctctcggtcagtgg

SEQ ID NO: 742 - DNA, 18 bp, Artificial Sequence
  Synthetic DNA
actggtcctccatcggct

SEQ ID NO: 743 - DNA, 24 bp, Artificial Sequence
  Synthetic DNA
ccttgcacctcaaaccaaagctcc

SEQ ID NO: 744 - DNA, 21 bp, Artificial Sequence
  Synthetic DNA
ccagtgtagcatgagtgctga

SEQ ID NO: 745 - DNA, 20 bp, Artificial Sequence
  Synthetic DNA
actgtggcacttaggggaga

SEQ ID NO: 746 - DNA, 24 bp, Artificial Sequence
  Synthetic DNA
ctgcctctgcccaaagcaaatgtc

SEQ ID NO: 747 - DNA, 20 bp, Artificial Sequence
  Synthetic DNA
agtggaaatgtgtcctggct

SEQ ID NO: 748 - DNA, 23 bp, Artificial Sequence
  Synthetic DNA
cggttatgtcatgccagatacac

SEQ ID NO: 749 - DNA, 25 bp, Artificial Sequence
  Synthetic DNA
cctcaaaggtactccctcctcccgg

SEQ ID NO: 750 - DNA, 24 bp, Artificial Sequence
  Synthetic DNA
gaactgagacccactgaagaaagg

SEQ ID NO: 751 - DNA, 20 bp, Artificial Sequence
  Synthetic DNA
gtccaggtggatgtgaaaga

SEQ ID NO: 752 - DNA, 21 bp, Artificial Sequence
  Synthetic DNA
cagcaggccctcaaggagctg

SEQ ID NO: 753 - DNA, 20 bp, Artificial Sequence
  Synthetic DNA
cggccaggatacacatctta

SEQ ID NO: 754 - DNA, 19 bp, Artificial Sequence
  Synthetic DNA
tggccttcttcaccagcta

SEQ ID NO: 755 - DNA, 24 bp, Artificial Sequence
  Synthetic DNA
aggccacggtgctctccatgtact

SEQ ID NO: 756 - DNA, 20 bp, Artificial Sequence
  Synthetic DNA
caaggatcccctgctcatac

SEQ ID NO: 757 - DNA, 28 bp, Artificial Sequence
  Synthetic DNA
ataacaaagtgtagctctgacatgaatg

SEQ ID NO: 758 - DNA, 30 bp, Artificial Sequence
  Synthetic DNA
ttgtttgcatggacagtgcatctatctggt

SEQ ID NO: 759 - DNA, 24 bp, Artificial Sequence
  Synthetic DNA
cacacctgcagtagttttgactca

SEQ ID NO: 760 - DNA, 20 bp, Artificial Sequence
  Synthetic DNA
acggatcacagtggaggaag

SEQ ID NO: 761 - DNA, 20 bp, Artificial Sequence
  Synthetic DNA
cgctggctcacccctacctg

SEQ ID NO: 762 - DNA, 20 bp, Artificial Sequence
  Synthetic DNA
ctcatccgtcgggtcatagt

SEQ ID NO: 763 - DNA, 20 bp, Artificial Sequence
  Synthetic DNA
agttcttgacccctggtcct

SEQ ID NO: 764 - DNA, 20 bp, Artificial Sequence
  Synthetic DNA
tctccagcccgtcttggctt

SEQ ID NO: 765 - DNA, 20 bp, Artificial Sequence
  Synthetic DNA
aaacggctcaaaggagtcaa

SEQ ID NO: 766 - DNA, 18 bp, Artificial Sequence
  Synthetic DNA
acccccagaccggatcag

SEQ ID NO: 767 - DNA, 23 bp, Artificial Sequence
  Synthetic DNA
ctggccctcatgtccccttcacg

SEQ ID NO: 768 - DNA, 23 bp, Artificial Sequence
  Synthetic DNA
tgtagggcagacttcctcaaaca

SEQ ID NO: 769 - DNA, 19 bp, Artificial Sequence
  Synthetic DNA
cgtggtgcccctctatgac

SEQ ID NO: 770 - DNA, 19 bp, Artificial Sequence
  Synthetic DNA
ctggagatgctggacgccc

SEQ ID NO: 771 - DNA, 19 bp, Artificial Sequence
  Synthetic DNA
ggctagtgggcgcatgtag

SEQ ID NO: 772 - DNA, 18 bp, Artificial Sequence
  Synthetic DNA
tccagtgcctatgacccc

SEQ ID NO: 773 - DNA, 24 bp, Artificial Sequence
  Synthetic DNA
cagacaaatcgccatcaagtcccc

SEQ ID NO: 774 - DNA, 18 bp, Artificial Sequence
  Synthetic DNA
actgtccaagggcaccag

SEQ ID NO: 775 - DNA, 23 bp, Artificial Sequence
  Synthetic DNA
gtgaaggatgtgaagcagacgta

SEQ ID NO: 776 - DNA, 21 bp, Artificial Sequence
  Synthetic DNA
tggcacgggtcttctcctacc

SEQ ID NO: 777 - DNA, 20 bp, Artificial Sequence
  Synthetic DNA
aaccggtgctctccacattc

SEQ ID NO: 778 - DNA, 19 bp, Artificial Sequence
  Synthetic DNA
gctttgccaccaggaaagt

SEQ ID NO: 779 - DNA, 24 bp, Artificial Sequence
  Synthetic DNA
ctggcatggccaaacctaacatga

SEQ ID NO: 780 - DNA, 20 bp, Artificial Sequence
  Synthetic DNA
catccccattcacactgatg

SEQ ID NO: 781 - DNA, 18 bp, Artificial Sequence
  Synthetic DNA
ctgaccagaaccacggct

SEQ ID NO: 782 - DNA, 24 bp, Artificial Sequence
  Synthetic DNA
cggcctgtccacgaaccacttata

SEQ ID NO: 783 - DNA, 18 bp, Artificial Sequence
  Synthetic DNA
ggaagtgggtcatgtggg

SEQ ID NO: 784 - DNA, 21 bp, Artificial Sequence
  Synthetic DNA
ggattgctcaacaaccatgct

SEQ ID NO: 785 - DNA, 30 bp, Artificial Sequence
  Synthetic DNA
tctggaccctcctacctctggttcttacgt

SEQ ID NO: 786 - DNA, 24 bp, Artificial Sequence
  Synthetic DNA
ggcattaacacttttggacgataa

SEQ ID NO: 787 - DNA, 24 bp, Artificial Sequence
  Synthetic DNA
gcactttgggattctttccattat

SEQ ID NO: 788 - DNA, 29 bp, Artificial Sequence
  Synthetic DNA
acaacattctcggtgcctgtaacaaagaa

SEQ ID NO: 789 - DNA, 24 bp, Artificial Sequence
  Synthetic DNA
gcatgtaagaagaccctcactgaa

SEQ ID NO: 790 - DNA, 18 bp, Artificial Sequence
  Synthetic DNA
gcctcttcctgttcgacg

SEQ ID NO: 791 - DNA, 24 bp, Artificial Sequence
  Synthetic DNA
tcgcccacctacgtactggcctac

SEQ ID NO: 792 - DNA, 18 bp, Artificial Sequence
  Synthetic DNA
gctttgcccggtagctct

SEQ ID NO: 793 - DNA, 28 bp, Artificial Sequence
  Synthetic DNA
ggctattcctcattttctctacaaagtg

SEQ ID NO: 794 - DNA, 30 bp, Artificial Sequence
  Synthetic DNA
cctccaggaggctaccttcttcatgttcac

SEQ ID NO: 795 - DNA, 25 bp, Artificial Sequence
  Synthetic DNA
ggattgtagactgtcaccgaaattc

SEQ ID NO: 796 - DNA, 20 bp, Artificial Sequence
  Synthetic DNA
ccccagtttcaacgagactt

SEQ ID NO: 797 - DNA, 27 bp, Artificial Sequence
  Synthetic DNA
tcattgctccctaaagagttggcactc

SEQ ID NO: 798 - DNA, 20 bp, Artificial Sequence
  Synthetic DNA
gttccaggaatgaaagcaca

SEQ ID NO: 799 - DNA, 22 bp, Artificial Sequence
  Synthetic DNA
gagatgattcagttaccgggag

SEQ ID NO: 800 - DNA, 24 bp, Artificial Sequence
  Synthetic DNA
aatccacaggatccaaaatgggcc

SEQ ID NO: 801 - DNA, 20 bp, Artificial Sequence
  Synthetic DNA
atcttgtcctggagacccaa

SEQ ID NO: 802 - DNA, 18 bp, Artificial Sequence
  Synthetic DNA
ctctgcaggcctaggtgc

SEQ ID NO: 803 - DNA, 24 bp, Artificial Sequence
  Synthetic DNA
ctcctcagcggctccagctcatat

SEQ ID NO: 804 - DNA, 21 bp, Artificial Sequence
  Synthetic DNA
ccaggactgtgaagagctgtc

SEQ ID NO: 805 - DNA, 21 bp, Artificial Sequence
  Synthetic DNA
cggtagtcaagtccggatcaa

SEQ ID NO: 806 - DNA, 25 bp, Artificial Sequence
  Synthetic DNA
caaggagacggaattctacctgtgc

SEQ ID NO: 807 - DNA, 18 bp, Artificial Sequence
  Synthetic DNA
gcttgcctttgcggttca

SEQ ID NO: 808 - DNA, 20 bp, Artificial Sequence
  Synthetic DNA
agatgcaggagagaggaagc

SEQ ID NO: 809 - DNA, 24 bp, Artificial Sequence
  Synthetic DNA
cctgcagactgctttttgcccaat

SEQ ID NO: 810 - DNA, 20 bp, Artificial Sequence
  Synthetic DNA
gttttgcagccttacccaat

SEQ ID NO: 811 - DNA, 20 bp, Artificial Sequence
  Synthetic DNA
cacgggacattcaccacatc

SEQ ID NO: 812 - DNA, 27 bp, Artificial Sequence
  Synthetic DNA
ataaaaagacaaccaacggccgactgc

SEQ ID NO: 813 - DNA, 19 bp, Artificial Sequence
  Synthetic DNA
gggtgccatccacttcaca

SEQ ID NO: 814 - DNA, 19 bp, Artificial Sequence
  Synthetic DNA
gagggactgttggcatgca

SEQ ID NO: 815 - DNA, 27 bp, Artificial Sequence
  Synthetic DNA
tcccagagaccaacgttcaagcagttg

SEQ ID NO: 816 - DNA, 25 bp, Artificial Sequence
  Synthetic DNA
gagtgagaattcgatccaagtcttc

SEQ ID NO: 817 - DNA, 18 bp, Artificial Sequence
  Synthetic DNA
ccagtggagcgcttccat

SEQ ID NO: 818 - DNA, 23 bp, Artificial Sequence
  Synthetic DNA
tcggccacttcatcaggacgcag

SEQ ID NO: 819 - DNA, 22 bp, Artificial Sequence
  Synthetic DNA
ctctctgggtcgtctgaaacaa

SEQ ID NO: 820 - DNA, 22 bp, Artificial Sequence
  Synthetic DNA
ggttccagctttctgtagctgt

SEQ ID NO: 821 - DNA, 24 bp, Artificial Sequence
  Synthetic DNA
attggtggccacaccacctcctta

SEQ ID NO: 822 - DNA, 19 bp, Artificial Sequence
  Synthetic DNA
gccgcaggttctagttgct

SEQ ID NO: 823 - DNA, 19 bp, Artificial Sequence
  Synthetic DNA
ccaccagcatgaagtttcg

SEQ ID NO: 824 - DNA, 24 bp, Artificial Sequence
  Synthetic DNA
acccctcacaaaggccatgtctgt

SEQ ID NO: 825 - DNA, 20 bp, Artificial Sequence
  Synthetic DNA
ggctgtctgaagcacaactg

SEQ ID NO: 826 - DNA, 19 bp, Artificial Sequence
  Synthetic DNA
gccacacaaacatgctcct

SEQ ID NO: 827 - DNA, 24 bp, Artificial Sequence
  Synthetic DNA
atgtctttcccagcagctctgcct

SEQ ID NO: 828 - DNA, 18 bp, Artificial Sequence
  Synthetic DNA
gccacaggaaacttccga

SEQ ID NO: 829 - DNA, 20 bp, Artificial Sequence
  Synthetic DNA
ggctcccgaatctatctttg

SEQ ID NO: 830 - DNA, 24 bp, Artificial Sequence
  Synthetic DNA
ctacagcaccaagagcgacgtgtg

SEQ ID NO: 831 - DNA, 20 bp, Artificial Sequence
  Synthetic DNA
tcccacagcaatactccgta

SEQ ID NO: 832 - DNA, 20 bp, Artificial Sequence
  Synthetic DNA
accaagaagctgaggacctg

SEQ ID NO: 833 - DNA, 23 bp, Artificial Sequence
  Synthetic DNA
agcccgctgaccatggaagatct

SEQ ID NO: 834 - DNA, 20 bp, Artificial Sequence
  Synthetic DNA
cctggaagctgtagcagaca

SEQ ID NO: 835 - DNA, 21 bp, Artificial Sequence
  Synthetic DNA
cgagccctttgatgacttcct

SEQ ID NO: 836 - DNA, 22 bp, Artificial Sequence
  Synthetic DNA
tcccagcatcatccaggcccag

SEQ ID NO: 837 - DNA, 18 bp, Artificial Sequence
  Synthetic DNA
ggagcgggctgtctcaga

SEQ ID NO: 838 - DNA, 20 bp, Artificial Sequence
  Synthetic DNA
tgaagtccaggacgatgatg

SEQ ID NO: 839 - DNA, 24 bp, Artificial Sequence
  Synthetic DNA
ctctacagcagctcagccagcctg

SEQ ID NO: 840 - DNA, 20 bp, Artificial Sequence
  Synthetic DNA
acggcttgcttactgaaggt

SEQ ID NO: 841 - DNA, 18 bp, Artificial Sequence
  Synthetic DNA
cagccctgccagtttgac

SEQ ID NO: 842 - DNA, 24 bp, Artificial Sequence
  Synthetic DNA
atgccgtcttctgccctaacctga

SEQ ID NO: 843 - DNA, 19 bp, Artificial Sequence
  Synthetic DNA
gttgcctgtggatgacacc

SEQ ID NO: 844 - DNA, 20 bp, Artificial Sequence
  Synthetic DNA
ttggtacctgtgggttagca

SEQ ID NO: 845 - DNA, 26 bp, Artificial Sequence
  Synthetic DNA
tccccagggtagaattcaatcagagc

SEQ ID NO: 846 - DNA, 20 bp, Artificial Sequence
  Synthetic DNA
cacatccaaatgcaaactgg

SEQ ID NO: 847 - DNA, 23 bp, Artificial Sequence
  Synthetic DNA
gtaagtcggatgagcctgtctgt

SEQ ID NO: 848 - DNA, 26 bp, Artificial Sequence
  Synthetic DNA
ccagtgacaatgccacttatgccagc

SEQ ID NO: 849 - DNA, 21 bp, Artificial Sequence
  Synthetic DNA
cagcttccttcatggcacact

SEQ ID NO: 850 - DNA, 24 bp, Artificial Sequence
  Synthetic DNA
aagtcctcgatacgcactatagca

SEQ ID NO: 851 - DNA, 21 bp, Artificial Sequence
  Synthetic DNA
cccggatggtctccacgtcat

SEQ ID NO: 852 - DNA, 19 bp, Artificial Sequence
  Synthetic DNA
ctggcatgtggcacatgag

SEQ ID NO: 853 - DNA, 26 bp, Artificial Sequence
  Synthetic DNA
ggataattcagacaacaacaccatct

SEQ ID NO: 854 - DNA, 29 bp, Artificial Sequence
  Synthetic DNA
tcaattgtaacattctcacccaggccttg

SEQ ID NO: 855 - DNA, 25 bp, Artificial Sequence
  Synthetic DNA
tgaagtaatcagccacagactcaat

SEQ ID NO: 856 - DNA, 19 bp, Artificial Sequence
  Synthetic DNA
ccgtgctcattgctaacca

SEQ ID NO: 857 - DNA, 24 bp, Artificial Sequence
  Synthetic DNA
tctgtccctgaactcccagaacca

SEQ ID NO: 858 - DNA, 19 bp, Artificial Sequence
  Synthetic DNA
ctgcccaaagccagatgta

SEQ ID NO: 859 - DNA, 20 bp, Artificial Sequence
  Synthetic DNA
cagttcggtccaacagagaa

SEQ ID NO: 860 - DNA, 24 bp, Artificial Sequence
  Synthetic DNA
agcaggcaaccaccatgtcatttg

SEQ ID NO: 861 - DNA, 20 bp, Artificial Sequence
  Synthetic DNA
tgcgaattatatcccgatga

SEQ ID NO: 862 - DNA, 20 bp, Artificial Sequence
  Synthetic DNA
cgtgtgtctcaagacgatcc

SEQ ID NO: 863 - DNA, 24 bp, Artificial Sequence
  Synthetic DNA
tgtgtaccctaatgggtcccgctt

SEQ ID NO: 864 - DNA, 18 bp, Artificial Sequence
  Synthetic DNA
ggtccctgtgctgtctgg

SEQ ID NO: 865 - DNA, 20 bp, Artificial Sequence
  Synthetic DNA
agagcaccaaagcagctcat

SEQ ID NO: 866 - DNA, 24 bp, Artificial Sequence
  Synthetic DNA
cactgatgacaccacgacgctctc

SEQ ID NO: 867 - DNA, 19 bp, Artificial Sequence
  Synthetic DNA
gtgcttggggatggtctct

SEQ ID NO: 868 - DNA, 20 bp, Artificial Sequence
  Synthetic DNA
gaagcgcagatcatgaagaa

SEQ ID NO: 869 - DNA, 24 bp, Artificial Sequence
  Synthetic DNA
ctgaagcacgacaagctggtccag

SEQ ID NO: 870 - DNA, 20 bp, Artificial Sequence
  Synthetic DNA
ctcctcagacaccactgcat

SEQ ID NO: 871 - DNA, 20 bp, Artificial Sequence
  Synthetic DNA
ggtgcaccagttctaccctc

SEQ ID NO: 872 - DNA, 24 bp, Artificial Sequence
  Synthetic DNA
acttgagctcagcggaacactgca

SEQ ID NO: 873 - DNA, 19 bp, Artificial Sequence
  Synthetic DNA
gcgtacatggagcacagga

SEQ ID NO: 874 - DNA, 18 bp, Artificial Sequence
  Synthetic DNA
tggatcctcacctggtcg

SEQ ID NO: 875 - DNA, 24 bp, Artificial Sequence
  Synthetic DNA
tgcgcttccaccttcttcactgtc

SEQ ID NO: 876 - DNA, 18 bp, Artificial Sequence
  Synthetic DNA
gcgctgcatgtctaccaa

SEQ ID NO: 877 - DNA, 20 bp, Artificial Sequence
  Synthetic DNA
aatgagagaggtgaaagcgg

SEQ ID NO: 878 - DNA, 24 bp, Artificial Sequence
  Synthetic DNA
cggagctagcacccccaggttaag

SEQ ID NO: 879 - DNA, 21 bp, Artificial Sequence
  Synthetic DNA
aggttcaccacagtcctgttc

SEQ ID NO: 880 - DNA, 19 bp, Artificial Sequence
  Synthetic DNA
tcagcagcaagggcatcat

SEQ ID NO: 881 - DNA, 19 bp, Artificial Sequence
  Synthetic DNA
cgcccgcaggcctcatcct

SEQ ID NO: 882 - DNA, 23 bp, Artificial Sequence
  Synthetic DNA
ggtggttttcttgagcgtgtact

SEQ ID NO: 883 - DNA, 19 bp, Artificial Sequence
  Synthetic DNA
caacgaattccaggtgtcc

SEQ ID NO: 884 - DNA, 23 bp, Artificial Sequence
  Synthetic DNA
ctgagcagctccatgtcggtgtc

SEQ ID NO: 885 - DNA, 18 bp, Artificial Sequence
  Synthetic DNA
gatctgcgccttcagctc

SEQ ID NO: 886 - DNA, 18 bp, Artificial Sequence
  Synthetic DNA
gtgctggtgacgaatcca

SEQ ID NO: 887 - DNA, 25 bp, Artificial Sequence
  Synthetic DNA
ttcatctcaatggaaggatcctgcc

SEQ ID NO: 888 - DNA, 20 bp, Artificial Sequence
  Synthetic DNA
cccggcaaaaacaaataagt

SEQ ID NO: 889 - DNA, 20 bp, Artificial Sequence
  Synthetic DNA
accctcgacaagaccacact

SEQ ID NO: 890 - DNA, 24 bp, Artificial Sequence
  Synthetic DNA
aacttcagccccagctcccaagtc

SEQ ID NO: 891 - DNA, 20 bp, Artificial Sequence
  Synthetic DNA
tgggagttcatgggtacaga

SEQ ID NO: 892 - DNA, 18 bp, Artificial Sequence
  Synthetic DNA
cgcgctgcagatccattt

SEQ ID NO: 893 - DNA, 23 bp, Artificial Sequence
  Synthetic DNA
cgctgatccaggctttctgctgc

SEQ ID NO: 894 - DNA, 22 bp, Artificial Sequence
  Synthetic DNA
cgcactatgtcgatgtcgttct

SEQ ID NO: 895 - DNA, 20 bp, Artificial Sequence
  Synthetic DNA
ggaacagggtcacccacaga

SEQ ID NO: 896 - DNA, 27 bp, Artificial Sequence
  Synthetic DNA
tcaggaccatcttcacactcacaccca

SEQ ID NO: 897 - DNA, 19 bp, Artificial Sequence
  Synthetic DNA
gatttggcgggtccatctc

SEQ ID NO: 898 - DNA, 20 bp, Artificial Sequence
  Synthetic DNA
ttgggaaatatttgggcatt

SEQ ID NO: 899 - DNA, 26 bp, Artificial Sequence
  Synthetic DNA
ttgggacattgtagacttggccagac

SEQ ID NO: 900 - DNA, 20 bp, Artificial Sequence
  Synthetic DNA
agaagctagggtggttgtcc

SEQ ID NO: 901 - DNA, 19 bp, Artificial Sequence
  Synthetic DNA
gcatgggaaccatcaacca

SEQ ID NO: 902 - DNA, 30 bp, Artificial Sequence
  Synthetic DNA
ccatggaccaacttcactatgtgacagagc

SEQ ID NO: 903 - DNA, 21 bp, Artificial Sequence
  Synthetic DNA
tgaggagtttgccttgattcg

SEQ ID NO: 904 - DNA, 20 bp, Artificial Sequence
  Synthetic DNA
ctgttgcaggaaggcattga

SEQ ID NO: 905 - DNA, 21 bp, Artificial Sequence
  Synthetic DNA
catctcctggcccagcatgtt

SEQ ID NO: 906 - DNA, 28 bp, Artificial Sequence
  Synthetic DNA
gtcagtgggtctctaataaagagatgag

SEQ ID NO: 907 - DNA, 30 bp, Artificial Sequence
  Synthetic DNA
tgtagaatcaaactcttcatcatcaactag

SEQ ID NO: 908 - DNA, 26 bp, Artificial Sequence
  Synthetic DNA
tgcagttgacatggcctgttcagtcc

SEQ ID NO: 909 - DNA, 22 bp, Artificial Sequence
  Synthetic DNA
cacagaatccagctgtgcaact

SEQ ID NO: 910 - DNA, 20 bp, Artificial Sequence
  Synthetic DNA
tggtgcttggagcatagaag

SEQ ID NO: 911 - DNA, 24 bp, Artificial Sequence
  Synthetic DNA
tgcccttcacaaaggaaatccctg

SEQ ID NO: 912 - DNA, 19 bp, Artificial Sequence
  Synthetic DNA
gcaacgtcctcagcatttc

SEQ ID NO: 913 - DNA, 21 bp, Artificial Sequence
  Synthetic DNA
cgctccagacctatgatgact

SEQ ID NO: 914 - DNA, 24 bp, Artificial Sequence
  Synthetic DNA
tgttagccaaagactgccactgca

SEQ ID NO: 915 - DNA, 20 bp, Artificial Sequence
  Synthetic DNA
acagtggaaggaccaggact

SEQ ID NO: 916 - DNA, 20 bp, Artificial Sequence
  Synthetic DNA
gtgtatgacgaggtggatcg

SEQ ID NO: 917 - DNA, 24 bp, Artificial Sequence
  Synthetic DNA
agccagccacactgcatcattttc

SEQ ID NO: 918 - DNA, 20 bp, Artificial Sequence
  Synthetic DNA
accagagtgctgtggttttg

SEQ ID NO: 919 - DNA, 19 bp, Artificial Sequence
  Synthetic DNA
gttcactgggggtgtatgg

SEQ ID NO: 920 - DNA, 24 bp, Artificial Sequence
  Synthetic DNA
atcccctccctctccacccatcta

SEQ ID NO: 921 - DNA, 23 bp, Artificial Sequence
  Synthetic DNA
aaataccaacatgcacctctctt

SEQ ID NO: 922 - DNA, 20 bp, Artificial Sequence
  Synthetic DNA
tgtcatgtacgacggcttct

SEQ ID NO: 923 - DNA, 21 bp, Artificial Sequence
  Synthetic DNA
aggcgttgcacttcaccagcc

SEQ ID NO: 924 - DNA, 20 bp, Artificial Sequence
  Synthetic DNA
agtccacagtgttgggacaa

SEQ ID NO: 925 - DNA, 18 bp, Artificial Sequence
  Synthetic DNA
gcttatgaccgaccccaa

SEQ ID NO: 926 - DNA, 24 bp, Artificial Sequence
  Synthetic DNA
ctcatcacctggtctccggtgtgt

SEQ ID NO: 927 - DNA, 20 bp, Artificial Sequence
  Synthetic DNA
aaagttccaggcaacatcgt

SEQ ID NO: 928 - DNA, 24 bp, Artificial Sequence
  Synthetic DNA
cacacagatctcctactccatcca

SEQ ID NO: 929 - DNA, 26 bp, Artificial Sequence
  Synthetic DNA
catgctgcatcctaaggctcctcagg

SEQ ID NO: 930 - DNA, 21 bp, Artificial Sequence
  Synthetic DNA
ggtccagcagtgtctcctgaa

SEQ ID NO: 931 - DNA, 19 bp, Artificial Sequence
  Synthetic DNA
cttcgcctttgctgattgc

SEQ ID NO: 932 - DNA, 24 bp, Artificial Sequence
  Synthetic DNA
ctccaaacgcctgcctgacgactg

SEQ ID NO: 933 - DNA, 20 bp, Artificial Sequence
  Synthetic DNA
ccataacgcacatgctccaa

SEQ ID NO: 934 - DNA, 20 bp, Artificial Sequence
  Synthetic DNA
tcccactgaagccctttcag

SEQ ID NO: 935 - DNA, 26 bp, Artificial Sequence
  Synthetic DNA
cctccaagcgagtccttcttcaaccg

SEQ ID NO: 936 - DNA, 20 bp, Artificial Sequence
  Synthetic DNA
agtgcccaggcgtaaacatc

SEQ ID NO: 937 - DNA, 20 bp, Artificial Sequence
  Synthetic DNA
gtccatcagtgcatgacgtt

SEQ ID NO: 938 - DNA, 26 bp, Artificial Sequence
  Synthetic DNA
aggccacgtatagtcctagctgacgc

SEQ ID NO: 939 - DNA, 20 bp, Artificial Sequence
  Synthetic DNA
agcccacttggtttcttgtt

SEQ ID NO: 940 - DNA, 20 bp, Artificial Sequence
  Synthetic DNA
ccatctgcatccatcttgtt

SEQ ID NO: 941 - DNA, 23 bp, Artificial Sequence
  Synthetic DNA
ctccccacccttgagaagtgcct

SEQ ID NO: 942 - DNA, 20 bp, Artificial Sequence
  Synthetic DNA
ggccaccagggtattatctg

SEQ ID NO: 943 - DNA, 18 bp, Artificial Sequence
  Synthetic DNA
gttgggtgcatctctcgg

SEQ ID NO: 944 - DNA, 24 bp, Artificial Sequence
  Synthetic DNA
aattcatgccgagatacagccgct

SEQ ID NO: 945 - DNA, 21 bp, Artificial Sequence
  Synthetic DNA
cgtgctccatcttcctagctt

SEQ ID NO: 946 - DNA, 23 bp, Artificial Sequence
  Synthetic DNA
cgaaaagatgctgaacagtgaca

SEQ ID NO: 947 - DNA, 28 bp, Artificial Sequence
  Synthetic DNA
cttcctcctcccttctggtcagttggat

SEQ ID NO: 948 - DNA, 20 bp, Artificial Sequence
  Synthetic DNA
tcaggaacagccaccagtga

SEQ ID NO: 949 - DNA, 23 bp, Artificial Sequence
  Synthetic DNA
ctgggtctcatagaagcaaagga

SEQ ID NO: 950 - DNA, 25 bp, Artificial Sequence
  Synthetic DNA
agaaaccaccagccacctcaaccca

SEQ ID NO: 951 - DNA, 19 bp, Artificial Sequence
  Synthetic DNA
ccacgaaggctgctgattg

SEQ ID NO: 952 - DNA, 18 bp, Artificial Sequence
  Synthetic DNA
atgctgctggccattcca

SEQ ID NO: 953 - DNA, 27 bp, Artificial Sequence
  Synthetic DNA
ccgtgttttctgacctccatcccttcc

SEQ ID NO: 954 - DNA, 21 bp, Artificial Sequence
  Synthetic DNA
aggtctggttggtgctttcct

SEQ ID NO: 955 - DNA, 18 bp, Artificial Sequence
  Synthetic DNA
gacaaggacggcagcaag

SEQ ID NO: 956 - DNA, 24 bp, Artificial Sequence
  Synthetic DNA
ccaggagttgccaccactgttgtc

SEQ ID NO: 957 - DNA, 18 bp, Artificial Sequence
  Synthetic DNA
ttgtggcctgtctggacc

SEQ ID NO: 958 - DNA, 20 bp, Artificial Sequence
  Synthetic DNA
tctccaacttccctctgctg

SEQ ID NO: 959 - DNA, 24 bp, Artificial Sequence
  Synthetic DNA
aggccctgaaaaccagaatcagca

SEQ ID NO: 960 - DNA, 18 bp, Artificial Sequence
  Synthetic DNA
acttcttcaccgtgggca

SEQ ID NO: 961 - DNA, 27 bp, Artificial Sequence
  Synthetic DNA
aagctatgaggaaaagaagtacacgat

SEQ ID NO: 962 - DNA, 30 bp, Artificial Sequence
  Synthetic DNA
tcagccactggcttctgtcataatcaggag

SEQ ID NO: 963 - DNA, 20 bp, Artificial Sequence
  Synthetic DNA
ggcccagcttgaatttttca

SEQ ID NO: 964 - DNA, 21 bp, Artificial Sequence
  Synthetic DNA
caatgccatcttgcgctacat

SEQ ID NO: 965 - DNA, 27 bp, Artificial Sequence
  Synthetic DNA
ctcgcaagcacaacatgtgtggtgaga

SEQ ID NO: 966 - DNA, 25 bp, Artificial Sequence
  Synthetic DNA
gtccactcgaatcttttcttcttca

SEQ ID NO: 967 - DNA, 20 bp, Artificial Sequence
  Synthetic DNA
gagaccctgctgtcccagaa

SEQ ID NO: 968 - DNA, 26 bp, Artificial Sequence
  Synthetic DNA
tcccacaatgaaggtcttgcctccct

SEQ ID NO: 969 - DNA, 23 bp, Artificial Sequence
  Synthetic DNA
ggttgtagtcagcgaaggagatc

SEQ ID NO: 970 - DNA, 19 bp, Artificial Sequence
  Synthetic DNA
caccatccccaccctgtct

SEQ ID NO: 971 - DNA, 23 bp, Artificial Sequence
  Synthetic DNA
cacagccgcctgaaagccacaat

SEQ ID NO: 972 - DNA, 21 bp, Artificial Sequence
  Synthetic DNA
ggcctcagtgtgcatcattct

SEQ ID NO: 973 - DNA, 18 bp, Artificial Sequence
  Synthetic DNA
ccggaaaggccaagacaa

SEQ ID NO: 974 - DNA, 19 bp, Artificial Sequence
  Synthetic DNA
cccgctcgcagagagccgg

SEQ ID NO: 975 - DNA, 20 bp, Artificial Sequence
  Synthetic DNA
aatacggcccactgggaact

SEQ ID NO: 976 - DNA, 20 bp, Artificial Sequence
  Synthetic DNA
gactccttcgtccccagttg

SEQ ID NO: 977 - DNA, 25 bp, Artificial Sequence
  Synthetic DNA
ttgggcctcccataattgctttgcc

SEQ ID NO: 978 - DNA, 21 bp, Artificial Sequence
  Synthetic DNA
tggcacttgaaggctctggta

SEQ ID NO: 979 - DNA, 23 bp, Artificial Sequence
  Synthetic DNA
tgacacccttaccttcctgagaa

SEQ ID NO: 980 - DNA, 21 bp, Artificial Sequence
  Synthetic DNA
tctgctttccgcgctcccagg

SEQ ID NO: 981 - DNA, 29 bp, Artificial Sequence
  Synthetic DNA
aaaaacacgagtcaaaaatagaagtcact

SEQ ID NO: 982 - DNA, 27 bp, Artificial Sequence
  Synthetic DNA
caagtaccacagcgatgactacattaa

SEQ ID NO: 983 - DNA, 23 bp, Artificial Sequence
  Synthetic DNA
ttcttgcgctccatccgtccaga

SEQ ID NO: 984 - DNA, 22 bp, Artificial Sequence
  Synthetic DNA
gcttgctgtactccgacatgtt

SEQ ID NO: 985 - DNA, 20 bp, Artificial Sequence
  Synthetic DNA
ggtggctacacaatccgtaa

SEQ ID NO: 986 - DNA, 27 bp, Artificial Sequence
  Synthetic DNA
tgcagtctcatatgtccaacatcgagc

SEQ ID NO: 987 - DNA, 20 bp, Artificial Sequence
  Synthetic DNA
tgggaatctcacaatcaagg

SEQ ID NO: 988 - DNA, 20 bp, Artificial Sequence
  Synthetic DNA
tcctaggcattctggacctc

SEQ ID NO: 989 - DNA, 24 bp, Artificial Sequence
  Synthetic DNA
cattcctacccctgatcccaaccc

SEQ ID NO: 990 - DNA, 20 bp, Artificial Sequence
  Synthetic DNA
gctgttgatgctccatcctt

SEQ ID NO: 991 - DNA, 19 bp, Artificial Sequence
  Synthetic DNA
agccgtgactgttgaggtc

SEQ ID NO: 992 - DNA, 21 bp, Artificial Sequence
  Synthetic DNA
aagtccagcatcgcaggcagc

SEQ ID NO: 993 - DNA, 20 bp, Artificial Sequence
  Synthetic DNA
aagtaacgttcccaggtgct

SEQ ID NO: 994 - DNA, 20 bp, Artificial Sequence
  Synthetic DNA
aggctgctggaggtcatctc

SEQ ID NO: 995 - DNA, 21 bp, Artificial Sequence
  Synthetic DNA
ccagaggccgtttcttggccg

SEQ ID NO: 996 - DNA, 19 bp, Artificial Sequence
  Synthetic DNA
cttcctgcggccacagtct

SEQ ID NO: 997 - DNA, 20 bp, Artificial Sequence
  Synthetic DNA
cggtgtgagaagtgcagcaa

SEQ ID NO: 998 - DNA, 24 bp, Artificial Sequence
  Synthetic DNA
ccagaccatagcacactcgggcac

SEQ ID NO: 999 - DNA, 19 bp, Artificial Sequence
  Synthetic DNA
cctctcgcaagtgctccat

SEQ ID NO: 1000 - DNA, 20 bp, Artificial Sequence
  Synthetic DNA
caccctgtcctatccttcct

SEQ ID NO: 1001 - DNA, 25 bp, Artificial Sequence
  Synthetic DNA
ccctcttgggacctagtctctgcct

SEQ ID NO: 1002 - DNA, 20 bp, Artificial Sequence
  Synthetic DNA
ggccaggggtagagagtaga

SEQ ID NO: 1003 - DNA, 19 bp, Artificial Sequence
  Synthetic DNA
ttagggaccctgcagctct

SEQ ID NO: 1004 - DNA, 22 bp, Artificial Sequence
  Synthetic DNA
agctccctccctccacccactc

SEQ ID NO: 1005 - DNA, 22 bp, Artificial Sequence
  Synthetic DNA
ctacaaaattcttcctcctgcc

SEQ ID NO: 1006 - DNA, 20 bp, Artificial Sequence
  Synthetic DNA
ccgaaatccagatgatgatg

SEQ ID NO: 1007 - DNA, 22 bp, Artificial Sequence
  Synthetic DNA
ctcatgaccctggtgctacacg

SEQ ID NO: 1008 - DNA, 20 bp, Artificial Sequence
  Synthetic DNA
cccaaggaatgagtggattt

SEQ ID NO: 1009 - DNA, 24 bp, Artificial Sequence
  Synthetic DNA
tgaacataaagtctgcaacatgga

SEQ ID NO: 1010 - DNA, 24 bp, Artificial Sequence
  Synthetic DNA
ttgcactgcacaggccacattcac

SEQ ID NO: 1011 - DNA, 28 bp, Artificial Sequence
  Synthetic DNA
tgaggttggttactgttggtatcatata

SEQ ID NO: 1012 - DNA, 18 bp, Artificial Sequence
  Synthetic DNA
tacgcacagaggcaagca

SEQ ID NO: 1013 - DNA, 24 bp, Artificial Sequence
  Synthetic DNA
taagagtccgggatccccagccta

SEQ ID NO: 1014 - DNA, 20 bp, Artificial Sequence
  Synthetic DNA
gagagaagtgctggagaggc

SEQ ID NO: 1015 - DNA, 21 bp, Artificial Sequence
  Synthetic DNA
tccatgatggttctgcaggtt

SEQ ID NO: 1016 - DNA, 21 bp, Artificial Sequence
  Synthetic DNA
ccccggacagtggctctgacg

SEQ ID NO: 1017 - DNA, 21 bp, Artificial Sequence
  Synthetic DNA
tgagcagcaccatcagtaacg

SEQ ID NO: 1018 - DNA, 20 bp, Artificial Sequence
  Synthetic DNA
gacgatttgccagctttgag

SEQ ID NO: 1019 - DNA, 24 bp, Artificial Sequence
  Synthetic DNA
tcaaggtgcattggccaacatagc

SEQ ID NO: 1020 - DNA, 18 bp, Artificial Sequence
  Synthetic DNA
tccaggttggctttgtcc

SEQ ID NO: 1021 - DNA, 20 bp, Artificial Sequence
  Synthetic DNA
gctttctcaggacctggttg

SEQ ID NO: 1022 - DNA, 24 bp, Artificial Sequence
  Synthetic DNA
cattttctgcagttgccgaaccag

SEQ ID NO: 1023 - DNA, 18 bp, Artificial Sequence
  Synthetic DNA
aggaagccacaagggagg

SEQ ID NO: 1024 - DNA, 19 bp, Artificial Sequence
  Synthetic DNA
cctgcgcggctactacaac

SEQ ID NO: 1025 - DNA, 25 bp, Artificial Sequence
  Synthetic DNA
cgaggccagttctcacaccctccag

SEQ ID NO: 1026 - DNA, 19 bp, Artificial Sequence
  Synthetic DNA
caggtcgcagccaatcatc

SEQ ID NO: 1027 - DNA, 19 bp, Artificial Sequence
  Synthetic DNA
tggcctgtccattggtgat

SEQ ID NO: 1028 - DNA, 28 bp, Artificial Sequence
  Synthetic DNA
ttccacatctctcccagtttcttcgcaa

SEQ ID NO: 1029 - DNA, 22 bp, Artificial Sequence
  Synthetic DNA
gcttgtcatctgcagcagtgtt

SEQ ID NO: 1030 - DNA, 20 bp, Artificial Sequence
  Synthetic DNA
ctacttccagcaaccccaga

SEQ ID NO: 1031 - DNA, 20 bp, Artificial Sequence
  Synthetic DNA
tccacatcagaatcttcccg

SEQ ID NO: 1032 - DNA, 20 bp, Artificial Sequence
  Synthetic DNA
ctttcgggaatcatcttcca

SEQ ID NO: 1033 - DNA, 19 bp, Artificial Sequence
  Synthetic DNA
caagggagcgaccaactga

SEQ ID NO: 1034 - DNA, 28 bp, Artificial Sequence
  Synthetic DNA
ctccatatccaaacaaagcatgtgtgcg

SEQ ID NO: 1035 - DNA, 28 bp, Artificial Sequence
  Synthetic DNA
gtttgccaagttaaatttggtacataat

SEQ ID NO: 1036 - DNA, 20 bp, Artificial Sequence
  Synthetic DNA
gccagtaagaacgaggagga

SEQ ID NO: 1037 - DNA, 24 bp, Artificial Sequence
  Synthetic DNA
aaggccattcaaactcctccccac

SEQ ID NO: 1038 - DNA, 19 bp, Artificial Sequence
  Synthetic DNA
cgtcgctgcttcagagtgt

SEQ ID NO: 1039 - DNA, 23 bp, Artificial Sequence
  Synthetic DNA
agtgacagatggacaatgcaaga

SEQ ID NO: 1040 - DNA, 24 bp, Artificial Sequence
  Synthetic DNA
tgaactccttcctggaatacccca

SEQ ID NO: 1041 - DNA, 20 bp, Artificial Sequence
  Synthetic DNA
ccgagtcgccactgctaagt

SEQ ID NO: 1042 - DNA, 22 bp, Artificial Sequence
  Synthetic DNA
tcccttgtgttccttctgtgaa

SEQ ID NO: 1043 - DNA, 28 bp, Artificial Sequence
  Synthetic DNA
agccctgttctcgttgccctaattcatc

SEQ ID NO: 1044 - DNA, 24 bp, Artificial Sequence
  Synthetic DNA
ggcaataaacaggctcatgattaa

SEQ ID NO: 1045 - DNA, 21 bp, Artificial Sequence
  Synthetic DNA
cgtgccttatggttactttgg

SEQ ID NO: 1046 - DNA, 24 bp, Artificial Sequence
  Synthetic DNA
acactcggcaggagtagtacccgc

SEQ ID NO: 1047 - DNA, 18 bp, Artificial Sequence
  Synthetic DNA
cacagggtttcagcgagc

SEQ ID NO: 1048 - DNA, 20 bp, Artificial Sequence
  Synthetic DNA
cagcctcaagttcggttttc

SEQ ID NO: 1049 - DNA, 24 bp, Artificial Sequence
  Synthetic DNA
accggagccttcccagaacaaact

SEQ ID NO: 1050 - DNA, 18 bp, Artificial Sequence
  Synthetic DNA
gttggaagcaaacgcaca

SEQ ID NO: 1051 - DNA, 19 bp, Artificial Sequence
  Synthetic DNA
ggacgaatacgaccccact

SEQ ID NO: 1052 - DNA, 24 bp, Artificial Sequence
  Synthetic DNA
accacctgcttccggtaggaatcc

SEQ ID NO: 1053 - DNA, 18 bp, Artificial Sequence
  Synthetic DNA
gcacgtctccccatcaat

SEQ ID NO: 1054 - DNA, 19 bp, Artificial Sequence
  Synthetic DNA
ggagatggccgagactgac

SEQ ID NO: 1055 - DNA, 23 bp, Artificial Sequence
  Synthetic DNA
caagaccgtgcaggacctcacct

SEQ ID NO: 1056 - DNA, 19 bp, Artificial Sequence
  Synthetic DNA
ctgcaggagtgtctgcacc

SEQ ID NO: 1057 - DNA, 18 bp, Artificial Sequence
  Synthetic DNA
ctggaccgcacggacatc

SEQ ID NO: 1058 - DNA, 25 bp, Artificial Sequence
  Synthetic DNA
accgcttctaccaatacctcgccca

SEQ ID NO: 1059 - DNA, 18 bp, Artificial Sequence
  Synthetic DNA
cgcctcgcgaaagacttg

SEQ ID NO: 1060 - DNA, 20 bp, Artificial Sequence
  Synthetic DNA
gctttccaagtggggaatta

SEQ ID NO: 1061 - DNA, 24 bp, Artificial Sequence
  Synthetic DNA
agttgcttccatccaacctggagg

SEQ ID NO: 1062 - DNA, 20 bp, Artificial Sequence
  Synthetic DNA
tgcctgcgatatttgttagg

SEQ ID NO: 1063 - DNA, 19 bp, Artificial Sequence
  Synthetic DNA
ctgctgcgacagtccacta

SEQ ID NO: 1064 - DNA, 24 bp, Artificial Sequence
  Synthetic DNA
agagtgactcccgttgtcccaagg

SEQ ID NO: 1065 - DNA, 18 bp, Artificial Sequence
  Synthetic DNA
caggttcgctctgggaag

SEQ ID NO: 1066 - DNA, 19 bp, Artificial Sequence
  Synthetic DNA
ggtccgcttcgtctttcga

SEQ ID NO: 1067 - DNA, 20 bp, Artificial Sequence
  Synthetic DNA
tgactcccgcggtcccaagg

SEQ ID NO: 1068 - DNA, 19 bp, Artificial Sequence
  Synthetic DNA
gcacaggttcgctctggaa

SEQ ID NO: 1069 - DNA, 20 bp, Artificial Sequence
  Synthetic DNA
ttcagtgtgtccagtgcatc

SEQ ID NO: 1070 - DNA, 29 bp, Artificial Sequence
  Synthetic DNA
cattttcctcagacttgtgaacctccact

SEQ ID NO: 1071 - DNA, 20 bp, Artificial Sequence
  Synthetic DNA
atctgtttccattggctcct

SEQ ID NO: 1072 - DNA, 24 bp, Artificial Sequence
  Synthetic DNA
ggctagtagaactggatcccaaca

SEQ ID NO: 1073 - DNA, 30 bp, Artificial Sequence
  Synthetic DNA
taattagacctaggcctcagctgcactgcc

SEQ ID NO: 1074 - DNA, 20 bp, Artificial Sequence
  Synthetic DNA
ggtctgcccaaatgcttttc

SEQ ID NO: 1075 - DNA, 19 bp, Artificial Sequence
  Synthetic DNA
cctccctctggtggtgctt

SEQ ID NO: 1076 - DNA, 26 bp, Artificial Sequence
  Synthetic DNA
ctcagggcccaccattgaagaggttg

SEQ ID NO: 1077 - DNA, 26 bp, Artificial Sequence
  Synthetic DNA
gctacatctacacttggttggcttaa

SEQ ID NO: 1078 - DNA, 19 bp, Artificial Sequence
  Synthetic DNA
ccgactggaggagcataaa

SEQ ID NO: 1079 - DNA, 24 bp, Artificial Sequence
  Synthetic DNA
cgcacttttctgagcagacgtcca

SEQ ID NO: 1080 - DNA, 19 bp, Artificial Sequence
  Synthetic DNA
atgctggctgactctgctc

SEQ ID NO: 1081 - DNA, 20 bp, Artificial Sequence
  Synthetic DNA
caaaaggcagaggctgataa

SEQ ID NO: 1082 - DNA, 27 bp, Artificial Sequence
  Synthetic DNA
tgaccagatccttcacagacttgtcgt

SEQ ID NO: 1083 - DNA, 20 bp, Artificial Sequence
  Synthetic DNA
agcgcagtttcataaagcaa

SEQ ID NO: 1084 - DNA, 20 bp, Artificial Sequence
  Synthetic DNA
gcaagcaacagtagtcgctg

SEQ ID NO: 1085 - DNA, 25 bp, Artificial Sequence
  Synthetic DNA
tctccaccctttcctttagaacccg

SEQ ID NO: 1086 - DNA, 20 bp, Artificial Sequence
  Synthetic DNA
caactttcacgctaactggt

SEQ ID NO: 1087 - DNA, 20 bp, Artificial Sequence
  Synthetic DNA
gagtacgtgtgccgagtgtt

SEQ ID NO: 1088 - DNA, 23 bp, Artificial Sequence
  Synthetic DNA
cagctccgtgcctctagaggcct

SEQ ID NO: 1089 - DNA, 19 bp, Artificial Sequence
  Synthetic DNA
ctcaatggtgaccaggaca

SEQ ID NO: 1090 - DNA, 24 bp, Artificial Sequence
  Synthetic DNA
gcagacagtgaccatctacagctt

SEQ ID NO: 1091 - DNA, 20 bp, Artificial Sequence
  Synthetic DNA
ccggcgcccaacgtgattct

SEQ ID NO: 1092 - DNA, 22 bp, Artificial Sequence
  Synthetic DNA
cttctgagacctctggcttcgt

SEQ ID NO: 1093 - DNA, 20 bp, Artificial Sequence
  Synthetic DNA
ggtcatcctgacactgcaac

SEQ ID NO: 1094 - DNA, 21 bp, Artificial Sequence
  Synthetic DNA
ttgcccacagccaccaaagtg

SEQ ID NO: 1095 - DNA, 20 bp, Artificial Sequence
  Synthetic DNA
tgcactcaatggtgaaggac

SEQ ID NO: 1096 - DNA, 19 bp, Artificial Sequence
  Synthetic DNA
agaaccgcaaggtgagcaa

SEQ ID NO: 1097 - DNA, 26 bp, Artificial Sequence
  Synthetic DNA
tggagattctccagcacgtcatcgac

SEQ ID NO: 1098 - DNA, 21 bp, Artificial Sequence
  Synthetic DNA
tccaactgaaggtccctgatg

SEQ ID NO: 1099 - DNA, 23 bp, Artificial Sequence
  Synthetic DNA
aacgactgctactccaagctcaa

SEQ ID NO: 1100 - DNA, 22 bp, Artificial Sequence
  Synthetic DNA
tgcccagcatcccccagaacaa

SEQ ID NO: 1101 - DNA, 22 bp, Artificial Sequence
  Synthetic DNA
ggatttccatcttgctcacctt

SEQ ID NO: 1102 - DNA, 20 bp, Artificial Sequence
  Synthetic DNA
cttcaccaaatcccttcctg

SEQ ID NO: 1103 - DNA, 24 bp, Artificial Sequence
  Synthetic DNA
tcacagtccttcgctcctgagcac

SEQ ID NO: 1104 - DNA, 20 bp, Artificial Sequence
  Synthetic DNA
ctctggctcttcaggctaca

SEQ ID NO: 1105 - DNA, 19 bp, Artificial Sequence
  Synthetic DNA
tggcctggctcttaatttg

SEQ ID NO: 1106 - DNA, 30 bp, Artificial Sequence
  Synthetic DNA
cttttgttttgcccagtatagactcggaag

SEQ ID NO: 1107 - DNA, 19 bp, Artificial Sequence
  Synthetic DNA
tgcaatcatgcaagaccac

SEQ ID NO: 1108 - DNA, 20 bp, Artificial Sequence
  Synthetic DNA
tgacaaccaagcaaatgtga

SEQ ID NO: 1109 - DNA, 24 bp, Artificial Sequence
  Synthetic DNA
aagttgccccaggtcaccagactc

SEQ ID NO: 1110 - DNA, 20 bp, Artificial Sequence
  Synthetic DNA
cagtctgcccatgtggtaat

SEQ ID NO: 1111 - DNA, 21 bp, Artificial Sequence
  Synthetic DNA
tccggagctgtgatctaagga

SEQ ID NO: 1112 - DNA, 24 bp, Artificial Sequence
  Synthetic DNA
tgtattgcgcacccctcaagcctg

SEQ ID NO: 1113 - DNA, 20 bp, Artificial Sequence
  Synthetic DNA
cggacagagcgagctgactt

SEQ ID NO: 1114 - DNA, 21 bp, Artificial Sequence
  Synthetic DNA
gcatggtagccgaagatttca

SEQ ID NO: 1115 - DNA, 28 bp, Artificial Sequence
  Synthetic DNA
cgcgtcataccaaaatctccgattttga

SEQ ID NO: 1116 - DNA, 30 bp, Artificial Sequence
  Synthetic DNA
tttccggtaatagtctgtctcatagatatc

SEQ ID NO: 1117 - DNA, 19 bp, Artificial Sequence
  Synthetic DNA
ccgtgcttccggacaactt

SEQ ID NO: 1118 - DNA, 23 bp, Artificial Sequence
  Synthetic DNA
accccgtgggcaagttcttccaa

SEQ ID NO: 1119 - DNA, 20 bp, Artificial Sequence
  Synthetic DNA
tggactgcttccaggtgtca

SEQ ID NO: 1120 - DNA, 19 bp, Artificial Sequence
  Synthetic DNA
gtggacagcaccatgaaca

SEQ ID NO: 1121 - DNA, 20 bp, Artificial Sequence
  Synthetic DNA
cttccggccagcactgcctc

SEQ ID NO: 1122 - DNA, 19 bp, Artificial Sequence
  Synthetic DNA
cttcatacccgacttgagg

SEQ ID NO: 1123 - DNA, 17 bp, Artificial Sequence
  Synthetic DNA
acgcaccgggtgtctga

SEQ ID NO: 1124 - DNA, 24 bp, Artificial Sequence
  Synthetic DNA
cccaagttccaccccctccattca

SEQ ID NO: 1125 - DNA, 24 bp, Artificial Sequence
  Synthetic DNA
tgccctttcttgatgatgattatc

SEQ ID NO: 1126 - DNA, 22 bp, Artificial Sequence
  Synthetic DNA
tggacaagtacgggatgaagct

SEQ ID NO: 1127 - DNA, 24 bp, Artificial Sequence
  Synthetic DNA
cccgtcaacgtactccatgcctgg

SEQ ID NO: 1128 - DNA, 21 bp, Artificial Sequence
  Synthetic DNA
cgaaggtgtggcactgaaagt

SEQ ID NO: 1129 - DNA, 20 bp, Artificial Sequence
  Synthetic DNA
tgaaccgcagagaccaacag

SEQ ID NO: 1130 - DNA, 25 bp, Artificial Sequence
  Synthetic DNA
atccaggcacctctaccacgccctc

SEQ ID NO: 1131 - DNA, 20 bp, Artificial Sequence
  Synthetic DNA
gtcttggacacccgcagaat

SEQ ID NO: 1132 - DNA, 23 bp, Artificial Sequence
  Synthetic DNA
gggtcactatggagttcaaagga

SEQ ID NO: 1133 - DNA, 23 bp, Artificial Sequence
  Synthetic DNA
cccggtcaccaggcaggagttct

SEQ ID NO: 1134 - DNA, 19 bp, Artificial Sequence
  Synthetic DNA
gggtctgaatggccaggtt

SEQ ID NO: 1135 - DNA, 20 bp, Artificial Sequence
  Synthetic DNA
aaggacgaggagaacacagg

SEQ ID NO: 1136 - DNA, 21 bp, Artificial Sequence
  Synthetic DNA
atgacccagcgctgcaaggac

SEQ ID NO: 1137 - DNA, 20 bp, Artificial Sequence
  Synthetic DNA
agatagccagcgagttcagg

SEQ ID NO: 1138 - DNA, 26 bp, Artificial Sequence
  Synthetic DNA
aaggaaccatctcactgtgtgtaaac

SEQ ID NO: 1139 - DNA, 22 bp, Artificial Sequence
  Synthetic DNA
tgacttccaagctggccgtggc

SEQ ID NO: 1140 - DNA, 20 bp, Artificial Sequence
  Synthetic DNA
atcaggaaggctgccaagag

SEQ ID NO: 1141 - DNA, 20 bp, Artificial Sequence
  Synthetic DNA
ggcgctgtcatcgatttctt

SEQ ID NO: 1142 - DNA, 22 bp, Artificial Sequence
  Synthetic DNA
ctgctccacggccttgctcttg

SEQ ID NO: 1143 - DNA, 25 bp, Artificial Sequence
  Synthetic DNA
tggagcttattaaaggcattcttca

SEQ ID NO: 1144 - DNA, 20 bp, Artificial Sequence
  Synthetic DNA
agctgaggaagatgctggtt

SEQ ID NO: 1145 - DNA, 24 bp, Artificial Sequence
  Synthetic DNA
tgcccacagaccttccaggagaat

SEQ ID NO: 1146 - DNA, 20 bp, Artificial Sequence
  Synthetic DNA
ggaaagaaggtgctcaggtc

SEQ ID NO: 1147 - DNA, 20 bp, Artificial Sequence
  Synthetic DNA
cctgaaccttccaaagatgg

SEQ ID NO: 1148 - DNA, 27 bp, Artificial Sequence
  Synthetic DNA
ccagattggaagcatccatctttttca

SEQ ID NO: 1149 - DNA, 20 bp, Artificial Sequence
  Synthetic DNA
accaggcaagtctcctcatt

SEQ ID NO: 1150 - DNA, 20 bp, Artificial Sequence
  Synthetic DNA
ggcctaatgttccagatcct

SEQ ID NO: 1151 - DNA, 25 bp, Artificial Sequence
  Synthetic DNA
catattgcccagtggtcacctcaca

SEQ ID NO: 1152 - DNA, 20 bp, Artificial Sequence
  Synthetic DNA
aaaattgtgccttggaggag

SEQ ID NO: 1153 - DNA, 20 bp, Artificial Sequence
  Synthetic DNA
agccatcactctcagtgcag

SEQ ID NO: 1154 - DNA, 22 bp, Artificial Sequence
  Synthetic DNA
caggtcctatcgtggcccctga

SEQ ID NO: 1155 - DNA, 20 bp, Artificial Sequence
  Synthetic DNA
actgcagagtcagggtctcc

SEQ ID NO: 1156 - DNA, 19 bp, Artificial Sequence
  Synthetic DNA
gaaagtgtttgcggagcac

SEQ ID NO: 1157 - DNA, 24 bp, Artificial Sequence
  Synthetic DNA
ctcctacagcggccagttcttggt

SEQ ID NO: 1158 - DNA, 18 bp, Artificial Sequence
  Synthetic DNA
gaaggcgtagccggattt

SEQ ID NO: 1159 - DNA, 21 bp, Artificial Sequence
  Synthetic DNA
caatctgatcccagggttgaa

SEQ ID NO: 1160 - DNA, 27 bp, Artificial Sequence
  Synthetic DNA
ctcagcgcacttggcatcttttcaaca

SEQ ID NO: 1161 - DNA, 19 bp, Artificial Sequence
  Synthetic DNA
ggccctgctggtggagata

SEQ ID NO: 1162 - DNA, 20 bp, Artificial Sequence
  Synthetic DNA
tgtttccaagatcctgctga

SEQ ID NO: 1163 - DNA, 28 bp, Artificial Sequence
  Synthetic DNA
ccatctttgctttatctgaggctcgttc

SEQ ID NO: 1164 - DNA, 20 bp, Artificial Sequence
  Synthetic DNA
tctttctggttggctggaat

SEQ ID NO: 1165 - DNA, 20 bp, Artificial Sequence
  Synthetic DNA
cctacagcaagtgcaaggaa

SEQ ID NO: 1166 - DNA, 24 bp, Artificial Sequence
  Synthetic DNA
ccagctgcactttgtcgtcactgt

SEQ ID NO: 1167 - DNA, 20 bp, Artificial Sequence
  Synthetic DNA
catctcgtaggtctgcatgg

SEQ ID NO: 1168 - DNA, 23 bp, Artificial Sequence
  Synthetic DNA
cctcccagtttcatcttccacta

SEQ ID NO: 1169 - DNA, 24 bp, Artificial Sequence
  Synthetic DNA
atgtgcagcccacaaccaccatga

SEQ ID NO: 1170 - DNA, 21 bp, Artificial Sequence
  Synthetic DNA
agggactggaagggacaggtt

SEQ ID NO: 1171 - DNA, 19 bp, Artificial Sequence
  Synthetic DNA
gtgcccgagccatatagca

SEQ ID NO: 1172 - DNA, 25 bp, Artificial Sequence
  Synthetic DNA
acgtccgggtcctcactgtccttcc

SEQ ID NO: 1173 - DNA, 23 bp, Artificial Sequence
  Synthetic DNA
cggtagtggttgatgactgttga

SEQ ID NO: 1174 - DNA, 20 bp, Artificial Sequence
  Synthetic DNA
agcctccaggataccagcaa

SEQ ID NO: 1175 - DNA, 23 bp, Artificial Sequence
  Synthetic DNA
agctaagctgccatttgtcaccg

SEQ ID NO: 1176 - DNA, 21 bp, Artificial Sequence
  Synthetic DNA
tctccgactgacaggcatttg

SEQ ID NO: 1177 - DNA, 20 bp, Artificial Sequence
  Synthetic DNA
ccacagctcaccttctgtca

SEQ ID NO: 1178 - DNA, 20 bp, Artificial Sequence
  Synthetic DNA
tccatcccagctccagccag

SEQ ID NO: 1179 - DNA, 20 bp, Artificial Sequence
  Synthetic DNA
cctcagtgccagtctcttcc

SEQ ID NO: 1180 - DNA, 20 bp, Artificial Sequence
  Synthetic DNA
ccatgatcctcactctgctg

SEQ ID NO: 1181 - DNA, 24 bp, Artificial Sequence
  Synthetic DNA
cactccagacctcgcttagcatgg

SEQ ID NO: 1182 - DNA, 20 bp, Artificial Sequence
  Synthetic DNA
gaagctttgtagccggtgat

SEQ ID NO: 1183 - DNA, 21 bp, Artificial Sequence
  Synthetic DNA
caacgcttcagtgatcaatcc

SEQ ID NO: 1184 - DNA, 24 bp, Artificial Sequence
  Synthetic DNA
cgatcctgcatctgtaaatcgccc

SEQ ID NO: 1185 - DNA, 18 bp, Artificial Sequence
  Synthetic DNA
gtctggccgggattcttt

SEQ ID NO: 1186 - DNA, 20 bp, Artificial Sequence
  Synthetic DNA
aggccagccctacattatca

SEQ ID NO: 1187 - DNA, 24 bp, Artificial Sequence
  Synthetic DNA
tctgagccttgtcctctatccggc

SEQ ID NO: 1188 - DNA, 20 bp, Artificial Sequence
  Synthetic DNA
gtcttctccacagtccagca

SEQ ID NO: 1189 - DNA, 20 bp, Artificial Sequence
  Synthetic DNA
cagtgacaaacagcccttcc

SEQ ID NO: 1190 - DNA, 24 bp, Artificial Sequence
  Synthetic DNA
tcgccatcttttgtgggattcctt

SEQ ID NO: 1191 - DNA, 19 bp, Artificial Sequence
  Synthetic DNA
gtttagcctcatgggcgtc

SEQ ID NO: 1192 - DNA, 22 bp, Artificial Sequence
  Synthetic DNA
gatatgattggtcgctgctttg

SEQ ID NO: 1193 - DNA, 21 bp, Artificial Sequence
  Synthetic DNA
cagccaggacctggccatccg

SEQ ID NO: 1194 - DNA, 21 bp, Artificial Sequence
  Synthetic DNA
agaacttccattccccaccat

SEQ ID NO: 1195 - DNA, 21 bp, Artificial Sequence
  Synthetic DNA
actcggactgcacaagctatt

SEQ ID NO: 1196 - DNA, 24 bp, Artificial Sequence
  Synthetic DNA
ccgacagccacagaataacccaaa

SEQ ID NO: 1197 - DNA, 20 bp, Artificial Sequence
  Synthetic DNA
tgccatcaccattgaaatct

SEQ ID NO: 1198 - DNA, 20 bp, Artificial Sequence
  Synthetic DNA
tcagaattggatttggctca

SEQ ID NO: 1199 - DNA, 30 bp, Artificial Sequence
  Synthetic DNA
tgctaatgtaaggcatcacagtcttttcca

SEQ ID NO: 1200 - DNA, 20 bp, Artificial Sequence
  Synthetic DNA
cctgagcttagctggtgttg

SEQ ID NO: 1201 - DNA, 19 bp, Artificial Sequence
  Synthetic DNA
accgggagccctacatgac

SEQ ID NO: 1202 - DNA, 28 bp, Artificial Sequence
  Synthetic DNA
aaatacctgcaaccgttactgccgtgac

SEQ ID NO: 1203 - DNA, 27 bp, Artificial Sequence
  Synthetic DNA
ccttaagctctttcactgactcaatct

SEQ ID NO: 1204 - DNA, 18 bp, Artificial Sequence
  Synthetic DNA
caaggtgccctcagtgga

SEQ ID NO: 1205 - DNA, 24 bp, Artificial Sequence
  Synthetic DNA
caccaacctgtacccgtattgcga

SEQ ID NO: 1206 - DNA, 19 bp, Artificial Sequence
  Synthetic DNA
gcgcacaccttcatctcat

SEQ ID NO: 1207 - DNA, 20 bp, Artificial Sequence
  Synthetic DNA
tcgtgaaagatgaccaggag

SEQ ID NO: 1208 - DNA, 27 bp, Artificial Sequence
  Synthetic DNA
tgctatgtttctacaaaaccgccaagg

SEQ ID NO: 1209 - DNA, 20 bp, Artificial Sequence
  Synthetic DNA
ggtgaacatcatgacgcagt

SEQ ID NO: 1210 - DNA, 20 bp, Artificial Sequence
  Synthetic DNA
gtcaaaatggggagggacta

SEQ ID NO: 1211 - DNA, 29 bp, Artificial Sequence
  Synthetic DNA
tgtatcttgttgagctatccaaactgccc

SEQ ID NO: 1212 - DNA, 20 bp, Artificial Sequence
  Synthetic DNA
caggaccaccacagagtgag

SEQ ID NO: 1213 - DNA, 19 bp, Artificial Sequence
  Synthetic DNA
gagcgcaaagtggaaatcg

SEQ ID NO: 1214 - DNA, 27 bp, Artificial Sequence
  Synthetic DNA
taggaagcagctcccatctttccggta

SEQ ID NO: 1215 - DNA, 19 bp, Artificial Sequence
  Synthetic DNA
tcttcacgggcaccacatc

SEQ ID NO: 1216 - DNA, 20 bp, Artificial Sequence
  Synthetic DNA
tcctgctgctggtcatctac

SEQ ID NO: 1217 - DNA, 24 bp, Artificial Sequence
  Synthetic DNA
tgtcttcacaccctactcggctgc

SEQ ID NO: 1218 - DNA, 20 bp, Artificial Sequence
  Synthetic DNA
ccttcttccgtctccttcag

SEQ ID NO: 1219 - DNA, 18 bp, Artificial Sequence
  Synthetic DNA
cctatcagccgctggtgt

SEQ ID NO: 1220 - DNA, 24 bp, Artificial Sequence
  Synthetic DNA
atcctgctcggcctggcttacttc

SEQ ID NO: 1221 - DNA, 18 bp, Artificial Sequence
  Synthetic DNA
tggtggtgagcactgagg

SEQ ID NO: 1222 - DNA, 20 bp, Artificial Sequence
  Synthetic DNA
gaggacgaaggcctctacac

SEQ ID NO: 1223 - DNA, 24 bp, Artificial Sequence
  Synthetic DNA
caggcatgcagtgttcttggctgt

SEQ ID NO: 1224 - DNA, 20 bp, Artificial Sequence
  Synthetic DNA
aaaaatgcctccacttttgc

SEQ ID NO: 1225 - DNA, 19 bp, Artificial Sequence
  Synthetic DNA
cggactttgggtgcgactt

SEQ ID NO: 1226 - DNA, 23 bp, Artificial Sequence
  Synthetic DNA
ccacttgtcgaaccaccgctcgt

SEQ ID NO: 1227 - DNA, 24 bp, Artificial Sequence
  Synthetic DNA
ttacaactcttccactgggacgat

SEQ ID NO: 1228 - DNA, 19 bp, Artificial Sequence
  Synthetic DNA
gtgtcctggtccatgtggt

SEQ ID NO: 1229 - DNA, 24 bp, Artificial Sequence
  Synthetic DNA
cacgtgtctccacctccaaggaga

SEQ ID NO: 1230 - DNA, 18 bp, Artificial Sequence
  Synthetic DNA
gggaggtgcacactgagg

SEQ ID NO: 1231 - DNA, 20 bp, Artificial Sequence
  Synthetic DNA
ctaaggcacttgctggaagg

SEQ ID NO: 1232 - DNA, 24 bp, Artificial Sequence
  Synthetic DNA
tccataggcaagcacactggcatt

SEQ ID NO: 1233 - DNA, 18 bp, Artificial Sequence
  Synthetic DNA
tcttcccagctcctgtgg

SEQ ID NO: 1234 - DNA, 25 bp, Artificial Sequence
  Synthetic DNA
aattcctgctccaaaagaaagtctt

SEQ ID NO: 1235 - DNA, 22 bp, Artificial Sequence
  Synthetic DNA
aagccgctccactcgcatgtcc

SEQ ID NO: 1236 - DNA, 20 bp, Artificial Sequence
  Synthetic DNA
cgtgatgcgaagctctgaga

SEQ ID NO: 1237 - DNA, 20 bp, Artificial Sequence
  Synthetic DNA
ccacagggttgaagaaccag

SEQ ID NO: 1238 - DNA, 24 bp, Artificial Sequence
  Synthetic DNA
agccagttcctgctgttcctgtcc

SEQ ID NO: 1239 - DNA, 20 bp, Artificial Sequence
  Synthetic DNA
cacctgatgtgccagacttc

SEQ ID NO: 1240 - DNA, 18 bp, Artificial Sequence
  Synthetic DNA
gtccccgggatggatgtt

SEQ ID NO: 1241 - DNA, 29 bp, Artificial Sequence
  Synthetic DNA
catctcgcttatccaacaatgacttggca

SEQ ID NO: 1242 - DNA, 25 bp, Artificial Sequence
  Synthetic DNA
gatcagtcaagctgtctgacaattg

SEQ ID NO: 1243 - DNA, 18 bp, Artificial Sequence
  Synthetic DNA
gtgcaaccgcagcttctc

SEQ ID NO: 1244 - DNA, 24 bp, Artificial Sequence
  Synthetic DNA
ctctgaccacctggccctgcatat

SEQ ID NO: 1245 - DNA, 18 bp, Artificial Sequence
  Synthetic DNA
cgggcagtgctcagttct

SEQ ID NO: 1246 - DNA, 20 bp, Artificial Sequence
  Synthetic DNA
cacgagaccggctacttctc

SEQ ID NO: 1247 - DNA, 24 bp, Artificial Sequence
  Synthetic DNA
agtactcctccagagacggcagcg

SEQ ID NO: 1248 - DNA, 20 bp, Artificial Sequence
  Synthetic DNA
gctctaggcaggtctgttgc

SEQ ID NO: 1249 - DNA, 18 bp, Artificial Sequence
  Synthetic DNA
gcccagaggctccatcgt

SEQ ID NO: 1250 - DNA, 23 bp, Artificial Sequence
  Synthetic DNA
cctcttcctccccagtcggctga

SEQ ID NO: 1251 - DNA, 23 bp, Artificial Sequence
  Synthetic DNA
cagaggtttgaacagtgcagaca

SEQ ID NO: 1252 - DNA, 20 bp, Artificial Sequence
  Synthetic DNA
gacgtgagggtcctgattct

SEQ ID NO: 1253 - DNA, 24 bp, Artificial Sequence
  Synthetic DNA
ttaccccagctccatccttgcatc

SEQ ID NO: 1254 - DNA, 20 bp, Artificial Sequence
  Synthetic DNA
tcctcactcatcacgtcctc

SEQ ID NO: 1255 - DNA, 20 bp, Artificial Sequence
  Synthetic DNA
tgagagccaggcttcttgta

SEQ ID NO: 1256 - DNA, 25 bp, Artificial Sequence
  Synthetic DNA
tgtctcaaaatgccagccttctgaa

SEQ ID NO: 1257 - DNA, 20 bp, Artificial Sequence
  Synthetic DNA
atcctggtcctctttgctgt

SEQ ID NO: 1258 - DNA, 20 bp, Artificial Sequence
  Synthetic DNA
atgtgccagtgagcttgagt

SEQ ID NO: 1259 - DNA, 24 bp, Artificial Sequence
  Synthetic DNA
ccttggagaaacacaagcacctgc

SEQ ID NO: 1260 - DNA, 20 bp, Artificial Sequence
  Synthetic DNA
tgagcccctggttaacagta

SEQ ID NO: 1261 - DNA, 19 bp, Artificial Sequence
  Synthetic DNA
gagaccaaggttgcaaggc

SEQ ID NO: 1262 - DNA, 24 bp, Artificial Sequence
  Synthetic DNA
aagctcaaaggttcacacagggcc

SEQ ID NO: 1263 - DNA, 22 bp, Artificial Sequence
  Synthetic DNA
cagtccatgctgtgaaactctc

SEQ ID NO: 1264 - DNA, 21 bp, Artificial Sequence
  Synthetic DNA
tgagcggcagaatcaggagta

SEQ ID NO: 1265 - DNA, 24 bp, Artificial Sequence
  Synthetic DNA
ctcatggacatcaagtcgcggctg

SEQ ID NO: 1266 - DNA, 19 bp, Artificial Sequence
  Synthetic DNA
tgcggtaggtggcaatctc

SEQ ID NO: 1267 - DNA, 27 bp, Artificial Sequence
  Synthetic DNA
ggatgaagcttacatgaacaaggtaga

SEQ ID NO: 1268 - DNA, 21 bp, Artificial Sequence
  Synthetic DNA
cgtcggtcagcccttccaggc

SEQ ID NO: 1269 - DNA, 25 bp, Artificial Sequence
  Synthetic DNA
catatagctgcctgaggaagttgat

SEQ ID NO: 1270 - DNA, 20 bp, Artificial Sequence
  Synthetic DNA
cagatgaggcacatggagac

SEQ ID NO: 1271 - DNA, 24 bp, Artificial Sequence
  Synthetic DNA
ctgattcctcaggtccttggcctg

SEQ ID NO: 1272 - DNA, 20 bp, Artificial Sequence
  Synthetic DNA
ttgaaatggcagaacggtag

SEQ ID NO: 1273 - DNA, 20 bp, Artificial Sequence
  Synthetic DNA
actgaccaagcctgagacct

SEQ ID NO: 1274 - DNA, 23 bp, Artificial Sequence
  Synthetic DNA
ccactcgccatactgggtgcagt

SEQ ID NO: 1275 - DNA, 20 bp, Artificial Sequence
  Synthetic DNA
gtcacacttgcagcatttca

SEQ ID NO: 1276 - DNA, 21 bp, Artificial Sequence
  Synthetic DNA
actcaagcggaaattgaagca

SEQ ID NO: 1277 - DNA, 28 bp, Artificial Sequence
  Synthetic DNA
aggtcttatcagcacagtctccgcctcc

SEQ ID NO: 1278 - DNA, 21 bp, Artificial Sequence
  Synthetic DNA
actccctgaagccgagacact

SEQ ID NO: 1279 - DNA, 18 bp, Artificial Sequence
  Synthetic DNA
gtgaacgttccggagagc

SEQ ID NO: 1280 - DNA, 24 bp, Artificial Sequence
  Synthetic DNA
atccagagacgcttctgcgctctc

SEQ ID NO: 1281 - DNA, 20 bp, Artificial Sequence
  Synthetic DNA
acattcacatactcccggct

SEQ ID NO: 1282 - DNA, 19 bp, Artificial Sequence
  Synthetic DNA
cgctgggcaacattaagag

SEQ ID NO: 1283 - DNA, 24 bp, Artificial Sequence
  Synthetic DNA
tcaccactcggacgaggtaactcg

SEQ ID NO: 1284 - DNA, 21 bp, Artificial Sequence
  Synthetic DNA
agcatgctggttgtagttggt

SEQ ID NO: 1285 - DNA, 18 bp, Artificial Sequence
  Synthetic DNA
cagtgcctctcgcctgtc

SEQ ID NO: 1286 - DNA, 23 bp, Artificial Sequence
  Synthetic DNA
actgggacaagcctgacagcagc

SEQ ID NO: 1287 - DNA, 21 bp, Artificial Sequence
  Synthetic DNA
tgaagaggtcatcctgctctg

SEQ ID NO: 1288 - DNA, 19 bp, Artificial Sequence
  Synthetic DNA
gatgacggaaagcatccag

SEQ ID NO: 1289 - DNA, 24 bp, Artificial Sequence
  Synthetic DNA
tggaggcctctacaacaagggacc

SEQ ID NO: 1290 - DNA, 21 bp, Artificial Sequence
  Synthetic DNA
cccggaataactcgagtagga

SEQ ID NO: 1291 - DNA, 20 bp, Artificial Sequence
  Synthetic DNA
agcggaaaatggcagacaat

SEQ ID NO: 1292 - DNA, 25 bp, Artificial Sequence
  Synthetic DNA
acccagataacgcatcatggagcga

SEQ ID NO: 1293 - DNA, 20 bp, Artificial Sequence
  Synthetic DNA
cttgagggtttgggtttcca

SEQ ID NO: 1294 - DNA, 21 bp, Artificial Sequence
  Synthetic DNA
ttggtgccgttcctatagatg

SEQ ID NO: 1295 - DNA, 24 bp, Artificial Sequence
  Synthetic DNA
cagtgcttgcctccatcttcagga

SEQ ID NO: 1296 - DNA, 18 bp, Artificial Sequence
  Synthetic DNA
gaacctgccacgatcacc

SEQ ID NO: 1297 - DNA, 21 bp, Artificial Sequence
  Synthetic DNA
cacctggtctgggaagatacc

SEQ ID NO: 1298 - DNA, 24 bp, Artificial Sequence
  Synthetic DNA
accgagaccccaatcaaaacctcc

SEQ ID NO: 1299 - DNA, 19 bp, Artificial Sequence
  Synthetic DNA
aagagcagcaggacgaagg

SEQ ID NO: 1300 - DNA, 19 bp, Artificial Sequence
  Synthetic DNA
tgcaaacgctggtgtcaca

SEQ ID NO: 1301 - DNA, 22 bp, Artificial Sequence
  Synthetic DNA
cagccccccaactgacctcatc

SEQ ID NO: 1302 - DNA, 21 bp, Artificial Sequence
  Synthetic DNA
ccccacgagttctggttcttc

SEQ ID NO: 1303 - DNA, 20 bp, Artificial Sequence
  Synthetic DNA
cccatccagaacactgattg

SEQ ID NO: 1304 - DNA, 26 bp, Artificial Sequence
  Synthetic DNA
tgacctccatccctttcacttgaatg

SEQ ID NO: 1305 - DNA, 21 bp, Artificial Sequence
  Synthetic DNA
ctgctttctatgcaccctttc

SEQ ID NO: 1306 - DNA, 18 bp, Artificial Sequence
  Synthetic DNA
ccaatgggagaacaacgg

SEQ ID NO: 1307 - DNA, 24 bp, Artificial Sequence
  Synthetic DNA
caggctcagcaagctgaacacctg

SEQ ID NO: 1308 - DNA, 19 bp, Artificial Sequence
  Synthetic DNA
cgctgaggctggtactgtg

SEQ ID NO: 1309 - DNA, 19 bp, Artificial Sequence
  Synthetic DNA
tcagcgggctcttaaacaa

SEQ ID NO: 1310 - DNA, 24 bp, Artificial Sequence
  Synthetic DNA
cagctgtccccgcagtaaagaagc

SEQ ID NO: 1311 - DNA, 20 bp, Artificial Sequence
  Synthetic DNA
aagacaggagttgaccacgc

SEQ ID NO: 1312 - DNA, 20 bp, Artificial Sequence
  Synthetic DNA
cgactatgacccactggaca

SEQ ID NO: 1313 - DNA, 24 bp, Artificial Sequence
  Synthetic DNA
cgcccatccacccagtagatgaac

SEQ ID NO: 1314 - DNA, 19 bp, Artificial Sequence
  Synthetic DNA
cttggctcgcttgatgttc

SEQ ID NO: 1315 - DNA, 20 bp, Artificial Sequence
  Synthetic DNA
ggatgtagccatctctgcct

SEQ ID NO: 1316 - DNA, 24 bp, Artificial Sequence
  Synthetic DNA
atagacctcagggccttcgctgtg

SEQ ID NO: 1317 - DNA, 20 bp, Artificial Sequence
  Synthetic DNA
agttcaaagccaatagggca

SEQ ID NO: 1318 - DNA, 21 bp, Artificial Sequence
  Synthetic DNA
aatgctgatgacttggagcag

SEQ ID NO: 1319 - DNA, 24 bp, Artificial Sequence
  Synthetic DNA
cacagaccccacagaggatgaagc

SEQ ID NO: 1320 - DNA, 18 bp, Artificial Sequence
  Synthetic DNA
ctgcatcctctgtggggt

SEQ ID NO: 1321 - DNA, 26 bp, Artificial Sequence
  Synthetic DNA
tggttctgattaggtaacgtattgga

SEQ ID NO: 1322 - DNA, 25 bp, Artificial Sequence
  Synthetic DNA
ctgcccacaactcccttgcacgtaa

SEQ ID NO: 1323 - DNA, 21 bp, Artificial Sequence
  Synthetic DNA
ggtcaaggtgggacactgaag

SEQ ID NO: 1324 - DNA, 20 bp, Artificial Sequence
  Synthetic DNA
agaagctgtccctgcaagag

SEQ ID NO: 1325 - DNA, 25 bp, Artificial Sequence
  Synthetic DNA
catgttcttcacaatcgctgcatcc

SEQ ID NO: 1326 - DNA, 20 bp, Artificial Sequence
  Synthetic DNA
agccgtaccagctcagactt

SEQ ID NO: 1327 - DNA, 18 bp, Artificial Sequence
  Synthetic DNA
ccgggagcagggaatcac

SEQ ID NO: 1328 - DNA, 19 bp, Artificial Sequence
  Synthetic DNA
cggccacgatttcggcgct

SEQ ID NO: 1329 - DNA, 20 bp, Artificial Sequence
  Synthetic DNA
atgctgttgatgccgaatga

SEQ ID NO: 1330 - DNA, 23 bp, Artificial Sequence
  Synthetic DNA
gctgcctttggtaagaacatgtc

SEQ ID NO: 1331 - DNA, 22 bp, Artificial Sequence
  Synthetic DNA
tccatcttgccattcacgccgc

SEQ ID NO: 1332 - DNA, 23 bp, Artificial Sequence
  Synthetic DNA
atcccagcagtctcttcacaact

SEQ ID NO: 1333 - DNA, 22 bp, Artificial Sequence
  Synthetic DNA
ggacattactggcctgttcaca

SEQ ID NO: 1334 - DNA, 23 bp, Artificial Sequence
  Synthetic DNA
tgcattccagcctcccatttcca

SEQ ID NO: 1335 - DNA, 23 bp, Artificial Sequence
  Synthetic DNA
accaatactcaggagcaggatga

SEQ ID NO: 1336 - DNA, 20 bp, Artificial Sequence
  Synthetic DNA
tccatcaaggctttcgacta

SEQ ID NO: 1337 - DNA, 22 bp, Artificial Sequence
  Synthetic DNA
ctgcaggctgtacgccttctcg

SEQ ID NO: 1338 - DNA, 20 bp, Artificial Sequence
  Synthetic DNA
ctgctgcataaactcgtggt

SEQ ID NO: 1339 - DNA, 18 bp, Artificial Sequence
  Synthetic DNA
cggaccaccaggtcagag

SEQ ID NO: 1340 - DNA, 24 bp, Artificial Sequence
  Synthetic DNA
ccactcttccctgctctgcgaatt

SEQ ID NO: 1341 - DNA, 20 bp, Artificial Sequence
  Synthetic DNA
caggggtagtgggtgttgag

SEQ ID NO: 1342 - DNA, 23 bp, Artificial Sequence
  Synthetic DNA
gcctttcttacccagaagcagaa

SEQ ID NO: 1343 - DNA, 30 bp, Artificial Sequence
  Synthetic DNA
tctcaaagtcgtcatccttcagttctccca

SEQ ID NO: 1344 - DNA, 19 bp, Artificial Sequence
  Synthetic DNA
cagcccccagctcactgat

SEQ ID NO: 1345 - DNA, 20 bp, Artificial Sequence
  Synthetic DNA
ggttggcatcaaaaggaact

SEQ ID NO: 1346 - DNA, 26 bp, Artificial Sequence
  Synthetic DNA
aattgtccctgaaactctcctgcacc

SEQ ID NO: 1347 - DNA, 20 bp, Artificial Sequence
  Synthetic DNA
tgccataaatgcaattgtcc

SEQ ID NO: 1348 - DNA, 23 bp, Artificial Sequence
  Synthetic DNA
tgagtggaaaagcctgacctatg

SEQ ID NO: 1349 - DNA, 27 bp, Artificial Sequence
  Synthetic DNA
tgaagtcatcagctttgtgccaccacc

SEQ ID NO: 1350 - DNA, 23 bp, Artificial Sequence
  Synthetic DNA
ggactccatctcttcttggtcaa

SEQ ID NO: 1351 - DNA, 23 bp, Artificial Sequence
  Synthetic DNA
cagatggccactttgagaacatt

SEQ ID NO: 1352 - DNA, 28 bp, Artificial Sequence
  Synthetic DNA
agctgacaacagtgtgaacgaccagacc

SEQ ID NO: 1353 - DNA, 22 bp, Artificial Sequence
  Synthetic DNA
ggcagcattaaccacaaggatt

SEQ ID NO: 1354 - DNA, 21 bp, Artificial Sequence
  Synthetic DNA
caaacgggctcatcataatgc

SEQ ID NO: 1355 - DNA, 27 bp, Artificial Sequence
  Synthetic DNA
tgatgtggtccctacgttttcgttcca

SEQ ID NO: 1356 - DNA, 20 bp, Artificial Sequence
  Synthetic DNA
tcccgcaaactgtgaaagct

SEQ ID NO: 1357 - DNA, 21 bp, Artificial Sequence
  Synthetic DNA
gacttttgcccgctacctttc

SEQ ID NO: 1358 - DNA, 24 bp, Artificial Sequence
  Synthetic DNA
acagctcattgttgtcacgccgga

SEQ ID NO: 1359 - DNA, 26 bp, Artificial Sequence
  Synthetic DNA
gccactaactgcttcagtatgaagag

SEQ ID NO: 1360 - DNA, 20 bp, Artificial Sequence
  Synthetic DNA
ggagaacaatccccttgaga

SEQ ID NO: 1361 - DNA, 27 bp, Artificial Sequence
  Synthetic DNA
tggcctttctgtctacaaggatcacca

SEQ ID NO: 1362 - DNA, 20 bp, Artificial Sequence
  Synthetic DNA
atctcctggatggtgatggt

SEQ ID NO: 1363 - DNA, 24 bp, Artificial Sequence
  Synthetic DNA
tgatggtcctatgtgtcacattca

SEQ ID NO: 1364 - DNA, 30 bp, Artificial Sequence
  Synthetic DNA
caggtttcataccaacacaggcttcagcac

SEQ ID NO: 1365 - DNA, 20 bp, Artificial Sequence
  Synthetic DNA
tgggacaggaaacacaccaa

SEQ ID NO: 1366 - DNA, 19 bp, Artificial Sequence
  Synthetic DNA
cgctcagccagatgcaatc

SEQ ID NO: 1367 - DNA, 21 bp, Artificial Sequence
  Synthetic DNA
tgccccagtcacctgctgtta

SEQ ID NO: 1368 - DNA, 25 bp, Artificial Sequence
  Synthetic DNA
gcactgagatcttcctattggtgaa

SEQ ID NO: 1369 - DNA, 19 bp, Artificial Sequence
  Synthetic DNA
ggagccgactgcaagtaca

SEQ ID NO: 1370 - DNA, 24 bp, Artificial Sequence
  Synthetic DNA
atcacacgcaccccagttctcaaa

SEQ ID NO: 1371 - DNA, 18 bp, Artificial Sequence
  Synthetic DNA
gactttggtgcctgtgcc

SEQ ID NO: 1372 - DNA, 19 bp, Artificial Sequence
  Synthetic DNA
ctacagggacgccatcgaa

SEQ ID NO: 1373 - DNA, 23 bp, Artificial Sequence
  Synthetic DNA
cttacaccagcatcaagatccgg

SEQ ID NO: 1374 - DNA, 23 bp, Artificial Sequence
  Synthetic DNA
atccaaccaatcacctgaatgtt

SEQ ID NO: 1375 - DNA, 20 bp, Artificial Sequence
  Synthetic DNA
ggagtcgaaggtggacaatc

SEQ ID NO: 1376 - DNA, 24 bp, Artificial Sequence
  Synthetic DNA
aatggcaccggaacaaactcaacc

SEQ ID NO: 1377 - DNA, 21 bp, Artificial Sequence
  Synthetic DNA
tgggaacagctgtagtggagt

SEQ ID NO: 1378 - DNA, 20 bp, Artificial Sequence
  Synthetic DNA
gtgaaatgaaacgcaccaca

SEQ ID NO: 1379 - DNA, 20 bp, Artificial Sequence
  Synthetic DNA
cagccctttggggaagctgg

SEQ ID NO: 1380 - DNA, 20 bp, Artificial Sequence
  Synthetic DNA
gaccctgctcacaaccagac

SEQ ID NO: 1381 - DNA, 21 bp, Artificial Sequence
  Synthetic DNA
acggatctaccacaccattgc

SEQ ID NO: 1382 - DNA, 22 bp, Artificial Sequence
  Synthetic DNA
tttgacaccccttccccagcca

SEQ ID NO: 1383 - DNA, 26 bp, Artificial Sequence
  Synthetic DNA
tccatatccaacaaaaaaactcaaag

SEQ ID NO: 1384 - DNA, 21 bp, Artificial Sequence
  Synthetic DNA
gggagatcatcgggacaactc

SEQ ID NO: 1385 - DNA, 30 bp, Artificial Sequence
  Synthetic DNA
agcaagatttcctccaggtccatcaaaagg

SEQ ID NO: 1386 - DNA, 19 bp, Artificial Sequence
  Synthetic DNA
gggcctggttgaaaagcat

SEQ ID NO: 1387 - DNA, 19 bp, Artificial Sequence
  Synthetic DNA
ccaacgcttgccaaatcct

SEQ ID NO: 1388 - DNA, 24 bp, Artificial Sequence
  Synthetic DNA
aaccagctctctgtgaccccaatt

SEQ ID NO: 1389 - DNA, 24 bp, Artificial Sequence
  Synthetic DNA
acggtagtgacagcatcaaaactc

SEQ ID NO: 1390 - DNA, 20 bp, Artificial Sequence
  Synthetic DNA
ccatgatggagaggcagaca

SEQ ID NO: 1391 - DNA, 24 bp, Artificial Sequence
  Synthetic DNA
ctgggagcatggcgatggataccc

SEQ ID NO: 1392 - DNA, 21 bp, Artificial Sequence
  Synthetic DNA
ggagtccgtccttaccgtcaa

SEQ ID NO: 1393 - DNA, 26 bp, Artificial Sequence
  Synthetic DNA
ggatggtagcagtctagggattaact

SEQ ID NO: 1394 - DNA, 28 bp, Artificial Sequence
  Synthetic DNA
cctgtatgctgcaactcatgaacttggc

SEQ ID NO: 1395 - DNA, 22 bp, Artificial Sequence
  Synthetic DNA
ggaatgtcccatacccaaagaa

SEQ ID NO: 1396 - DNA, 20 bp, Artificial Sequence
  Synthetic DNA
gagaaccaatctcaccgaca

SEQ ID NO: 1397 - DNA, 24 bp, Artificial Sequence
  Synthetic DNA
acaggtattcctctgccagctgcc

SEQ ID NO: 1398 - DNA, 20 bp, Artificial Sequence
  Synthetic DNA
cacccgagtgtaaccatagc

SEQ ID NO: 1399 - DNA, 18 bp, Artificial Sequence
  Synthetic DNA
tcatggtgcccgtcaatg

SEQ ID NO: 1400 - DNA, 29 bp, Artificial Sequence
  Synthetic DNA
acctgatacgtcttggtcttcatcgccat

SEQ ID NO: 1401 - DNA, 23 bp, Artificial Sequence
  Synthetic DNA
cgattgtctttgctcttcatgtg

SEQ ID NO: 1402 - DNA, 20 bp, Artificial Sequence
  Synthetic DNA
aggggatgacttggacacat

SEQ ID NO: 1403 - DNA, 25 bp, Artificial Sequence
  Synthetic DNA
ctgccattcgacatgactgcaattt

SEQ ID NO: 1404 - DNA, 20 bp, Artificial Sequence
  Synthetic DNA
aaaactgcatggctttgtca

SEQ ID NO: 1405 - DNA, 22 bp, Artificial Sequence
  Synthetic DNA
tcatcctggcgatctacttcct

SEQ ID NO: 1406 - DNA, 26 bp, Artificial Sequence
  Synthetic DNA
tctgtcctggctggagtcgctttcat

SEQ ID NO: 1407 - DNA, 20 bp, Artificial Sequence
  Synthetic DNA
ccgttgagtggaatcagcaa

SEQ ID NO: 1408 - DNA, 20 bp, Artificial Sequence
  Synthetic DNA
agcgcctggaatctacaact

SEQ ID NO: 1409 - DNA, 24 bp, Artificial Sequence
  Synthetic DNA
cggagtccagtgttttcccacttg

SEQ ID NO: 1410 - DNA, 20 bp, Artificial Sequence
  Synthetic DNA
agagcccctggagagaagat

SEQ ID NO: 1411 - DNA, 20 bp, Artificial Sequence
  Synthetic DNA
acttgcaggctgctatcctt

SEQ ID NO: 1412 - DNA, 25 bp, Artificial Sequence
  Synthetic DNA
ttcctactctcaggggcagcatgtt

SEQ ID NO: 1413 - DNA, 20 bp, Artificial Sequence
  Synthetic DNA
agcagacttgaaccctggtc

SEQ ID NO: 1414 - DNA, 20 bp, Artificial Sequence
  Synthetic DNA
gatgcagaattgaggcagac

SEQ ID NO: 1415 - DNA, 29 bp, Artificial Sequence
  Synthetic DNA
caagaagatttacttcgtcgattcccaga

SEQ ID NO: 1416 - DNA, 20 bp, Artificial Sequence
  Synthetic DNA
tcttggcaagtcggttaaga

SEQ ID NO: 1417 - DNA, 21 bp, Artificial Sequence
  Synthetic DNA
tgattaccatcatggctcaga

SEQ ID NO: 1418 - DNA, 24 bp, Artificial Sequence
  Synthetic DNA
tcccaattgtcgcttcttctgcag

SEQ ID NO: 1419 - DNA, 20 bp, Artificial Sequence
  Synthetic DNA
cttgtgaaaatgccatccac

SEQ ID NO: 1420 - DNA, 20 bp, Artificial Sequence
  Synthetic DNA
tctattgggggattggtagg

SEQ ID NO: 1421 - DNA, 26 bp, Artificial Sequence
  Synthetic DNA
ccgttaccagctggaaattcctgaga

SEQ ID NO: 1422 - DNA, 20 bp, Artificial Sequence
  Synthetic DNA
caaattgcgagtggtgaaat

SEQ ID NO: 1423 - DNA, 20 bp, Artificial Sequence
  Synthetic DNA
gtgtgagaagtgtgccaagg

SEQ ID NO: 1424 - DNA, 23 bp, Artificial Sequence
  Synthetic DNA
ctctccgcctttgcacacacagt

SEQ ID NO: 1425 - DNA, 20 bp, Artificial Sequence
  Synthetic DNA
ctgcacttctctgcttctgc

SEQ ID NO: 1426 - DNA, 19 bp, Artificial Sequence
  Synthetic DNA
ccgccctcacctgaagaga

SEQ ID NO: 1427 - DNA, 21 bp, Artificial Sequence
  Synthetic DNA
cccagtgtccgccaaggagcg

SEQ ID NO: 1428 - DNA, 22 bp, Artificial Sequence
  Synthetic DNA
ggaataagttagccgcgcttct

SEQ ID NO: 1429 - DNA, 20 bp, Artificial Sequence
  Synthetic DNA
ggccaggatctgtggtggta

SEQ ID NO: 1430 - DNA, 23 bp, Artificial Sequence
  Synthetic DNA
ctctggccttccgagaaggtacc

SEQ ID NO: 1431 - DNA, 20 bp, Artificial Sequence
  Synthetic DNA
ctccacgtcgtggacattga

SEQ ID NO: 1432 - DNA, 20 bp, Artificial Sequence
  Synthetic DNA
ctatgagccatgtgggaacc

SEQ ID NO: 1433 - DNA, 24 bp, Artificial Sequence
  Synthetic DNA
agcttcgagacctgcaggaccatc

SEQ ID NO: 1434 - DNA, 18 bp, Artificial Sequence
  Synthetic DNA
atgttggagtggatgccg

SEQ ID NO: 1435 - DNA, 19 bp, Artificial Sequence
  Synthetic DNA
tgcccttgcactgtcctaa

SEQ ID NO: 1436 - DNA, 24 bp, Artificial Sequence
  Synthetic DNA
tcagccatcctgcacacctacacc

SEQ ID NO: 1437 - DNA, 18 bp, Artificial Sequence
  Synthetic DNA
cagccacactcatccacg

SEQ ID NO: 1438 - DNA, 20 bp, Artificial Sequence
  Synthetic DNA
gtacgaccaagagaaacggg

SEQ ID NO: 1439 - DNA, 24 bp, Artificial Sequence
  Synthetic DNA
tctgcccgtcttctccatggtagg

SEQ ID NO: 1440 - DNA, 19 bp, Artificial Sequence
  Synthetic DNA
cctgtccaggtccatctca

SEQ ID NO: 1441 - DNA, 22 bp, Artificial Sequence
  Synthetic DNA
acgagaacgagggcatctatgt

SEQ ID NO: 1442 - DNA, 25 bp, Artificial Sequence
  Synthetic DNA
cgcacctttccggtcttgacatcct

SEQ ID NO: 1443 - DNA, 22 bp, Artificial Sequence
  Synthetic DNA
gcatgtaggtgcttccaatcac

SEQ ID NO: 1444 - DNA, 23 bp, Artificial Sequence
  Synthetic DNA
gaaggaatgggaatcagtcatga

SEQ ID NO: 1445 - DNA, 23 bp, Artificial Sequence
  Synthetic DNA
tcaccctggagatcagctcccga

SEQ ID NO: 1446 - DNA, 26 bp, Artificial Sequence
  Synthetic DNA
gtctattagagtcagatccgggacat

SEQ ID NO: 1447 - DNA, 20 bp, Artificial Sequence
  Synthetic DNA
agaaactggaggagcaggac

SEQ ID NO: 1448 - DNA, 24 bp, Artificial Sequence
  Synthetic DNA
tgcagctgctccttgatgctcagt

SEQ ID NO: 1449 - DNA, 20 bp, Artificial Sequence
  Synthetic DNA
cttcaggaaacgatgctcct

SEQ ID NO: 1450 - DNA, 18 bp, Artificial Sequence
  Synthetic DNA
gccgagatcgccaagatg

SEQ ID NO: 1451 - DNA, 24 bp, Artificial Sequence
  Synthetic DNA
cagcattgtctgtcctccctggca

SEQ ID NO: 1452 - DNA, 27 bp, Artificial Sequence
  Synthetic DNA
cttttgatggtagagttccagtgattc

SEQ ID NO: 1453 - DNA, 27 bp, Artificial Sequence
  Synthetic DNA
cggtacttctcagggctaatatatacg

SEQ ID NO: 1454 - DNA, 26 bp, Artificial Sequence
  Synthetic DNA
ctcttctgcgtggtggtcaaccccta

SEQ ID NO: 1455 - DNA, 21 bp, Artificial Sequence
  Synthetic DNA
ccgagtagatgggcaggtgtt

SEQ ID NO: 1456 - DNA, 19 bp, Artificial Sequence
  Synthetic DNA
tgacggagcgtgagtgcat

SEQ ID NO: 1457 - DNA, 25 bp, Artificial Sequence
  Synthetic DNA
ccctccgagatctgccgcatgtact

SEQ ID NO: 1458 - DNA, 21 bp, Artificial Sequence
  Synthetic DNA
atgccctgcttgtggatgtac

SEQ ID NO: 1459 - DNA, 25 bp, Artificial Sequence
  Synthetic DNA
taactgacattcttgagcaccagat

SEQ ID NO: 1460 - DNA, 28 bp, Artificial Sequence
  Synthetic DNA
cgggctgttccctttgagaaccttaaca

SEQ ID NO: 1461 - DNA, 18 bp, Artificial Sequence
  Synthetic DNA
atggcttgcccacaatgc

SEQ ID NO: 1462 - DNA, 19 bp, Artificial Sequence
  Synthetic DNA
ctctcccagcacagcttga

SEQ ID NO: 1463 - DNA, 24 bp, Artificial Sequence
  Synthetic DNA
cctcactgagtcaaccagcctgga

SEQ ID NO: 1464 - DNA, 20 bp, Artificial Sequence
  Synthetic DNA
caccagtgtcatccagcaac

SEQ ID NO: 1465 - DNA, 20 bp, Artificial Sequence
  Synthetic DNA
tagttcccagctgaccatca

SEQ ID NO: 1466 - DNA, 25 bp, Artificial Sequence
  Synthetic DNA
ctcagcctcgtcgttcttatccacc

SEQ ID NO: 1467 - DNA, 20 bp, Artificial Sequence
  Synthetic DNA
cagccttgttctcagcaatg

SEQ ID NO: 1468 - DNA, 18 bp, Artificial Sequence
  Synthetic DNA
ctactgcggaaagtcggg

SEQ ID NO: 1469 - DNA, 24 bp, Artificial Sequence
  Synthetic DNA
ctggagtccaaactcgcttcctgc

SEQ ID NO: 1470 - DNA, 21 bp, Artificial Sequence
  Synthetic DNA
ggactgatcgtacacgaggtt

SEQ ID NO: 1471 - DNA, 18 bp, Artificial Sequence
  Synthetic DNA
agggcaacattccacagc

SEQ ID NO: 1472 - DNA, 24 bp, Artificial Sequence
  Synthetic DNA
ctgcaaggacactcatcacagcca

SEQ ID NO: 1473 - DNA, 18 bp, Artificial Sequence
  Synthetic DNA
cagtgctcctactccggc

SEQ ID NO: 1474 - DNA, 19 bp, Artificial Sequence
  Synthetic DNA
tatccatcctgatggcgtc

SEQ ID NO: 1475 - DNA, 24 bp, Artificial Sequence
  Synthetic DNA
cccagtgctgactttcctcaggga

SEQ ID NO: 1476 - DNA, 20 bp, Artificial Sequence
  Synthetic DNA
ttgaactgtgcattggtgtg

SEQ ID NO: 1477 - DNA, 21 bp, Artificial Sequence
  Synthetic DNA
tgctggctactgggtgttagt

SEQ ID NO: 1478 - DNA, 24 bp, Artificial Sequence
  Synthetic DNA
tgcagtcctgtgtgcttccctctc

SEQ ID NO: 1479 - DNA, 20 bp, Artificial Sequence
  Synthetic DNA
gacaaccagggacacagtca

SEQ ID NO: 1480 - DNA, 18 bp, Artificial Sequence
  Synthetic DNA
gtgaggcagcgcgactct

SEQ ID NO: 1481 - DNA, 21 bp, Artificial Sequence
  Synthetic DNA
tgccttcccgggctgaggact

SEQ ID NO: 1482 - DNA, 23 bp, Artificial Sequence
  Synthetic DNA
tgccaatggtgtacaacacttca

SEQ ID NO: 1483 - DNA, 20 bp, Artificial Sequence
  Synthetic DNA
actccagagctgacctccac

SEQ ID NO: 1484 - DNA, 24 bp, Artificial Sequence
  Synthetic DNA
ctacaatgacttcccaggctgggc

SEQ ID NO: 1485 - DNA, 20 bp, Artificial Sequence
  Synthetic DNA
tcagggcttcagtgtctcac

SEQ ID NO: 1486 - DNA, 20 bp, Artificial Sequence
  Synthetic DNA
cagaccaaggagatggacct

SEQ ID NO: 1487 - DNA, 24 bp, Artificial Sequence
  Synthetic DNA
aagctgtaaacatgagccgcacca

SEQ ID NO: 1488 - DNA, 18 bp, Artificial Sequence
  Synthetic DNA
agctgccagtgctatccg

SEQ ID NO: 1489 - DNA, 19 bp, Artificial Sequence
  Synthetic DNA
ctgccgggatggcttctat

SEQ ID NO: 1490 - DNA, 21 bp, Artificial Sequence
  Synthetic DNA
ctgagctctgcccggaccgct

SEQ ID NO: 1491 - DNA, 22 bp, Artificial Sequence
  Synthetic DNA
ccaggttctggaaactgtggat

SEQ ID NO: 1492 - DNA, 22 bp, Artificial Sequence
  Synthetic DNA
ccaaggaatcatgttcgttcag

SEQ ID NO: 1493 - DNA, 22 bp, Artificial Sequence
  Synthetic DNA
tggccagcagcctctcgtccac

SEQ ID NO: 1494 - DNA, 20 bp, Artificial Sequence
  Synthetic DNA
tggtgctcgggagtcagact

SEQ ID NO: 1495 - DNA, 20 bp, Artificial Sequence
  Synthetic DNA
gagagagtgagcgaaccctg

SEQ ID NO: 1496 - DNA, 24 bp, Artificial Sequence
  Synthetic DNA
ccaggctccaagaagcagctgaag

SEQ ID NO: 1497 - DNA, 18 bp, Artificial Sequence
  Synthetic DNA
cgtcgcactggagctctt

SEQ ID NO: 1498 - DNA, 21 bp, Artificial Sequence
  Synthetic DNA
ggctgctggtacaaatactgc

SEQ ID NO: 1499 - DNA, 29 bp, Artificial Sequence
  Synthetic DNA
tgtctgcccctattattggtgtcatttct

SEQ ID NO: 1500 - DNA, 20 bp, Artificial Sequence
  Synthetic DNA
caatctaagccacgctgttg

SEQ ID NO: 1501 - DNA, 20 bp, Artificial Sequence
  Synthetic DNA
tgatccatctctaggccaca

SEQ ID NO: 1502 - DNA, 24 bp, Artificial Sequence
  Synthetic DNA
ttgtcaccttagttgcccgggttc

SEQ ID NO: 1503 - DNA, 20 bp, Artificial Sequence
  Synthetic DNA
gagcaaatgggttgacacaa

SEQ ID NO: 1504 - DNA, 19 bp, Artificial Sequence
  Synthetic DNA
ccaaccctgcagactccaa

SEQ ID NO: 1505 - DNA, 25 bp, Artificial Sequence
  Synthetic DNA
cctgggaccatccgtggagacttct

SEQ ID NO: 1506 - DNA, 28 bp, Artificial Sequence
  Synthetic DNA
atgtataatgttcctgccaacttgtatg

SEQ ID NO: 1507 - DNA, 18 bp, Artificial Sequence
  Synthetic DNA
atctccgcctcgctcatg

SEQ ID NO: 1508 - DNA, 22 bp, Artificial Sequence
  Synthetic DNA
ttcactcgcttcgccatcaccg

SEQ ID NO: 1509 - DNA, 21 bp, Artificial Sequence
  Synthetic DNA
tcggagccatacaggattgtc

SEQ ID NO: 1510 - DNA, 20 bp, Artificial Sequence
  Synthetic DNA
cgggtccaccagtttgaatg

SEQ ID NO: 1511 - DNA, 19 bp, Artificial Sequence
  Synthetic DNA
ccgctctgcagccgggaca

SEQ ID NO: 1512 - DNA, 21 bp, Artificial Sequence
  Synthetic DNA
gttgtattggttcggcaccat

SEQ ID NO: 1513 - DNA, 20 bp, Artificial Sequence
  Synthetic DNA
cacttccctgctgggattat

SEQ ID NO: 1514 - DNA, 24 bp, Artificial Sequence
  Synthetic DNA
ccgtgttgcacagctcatcacact

SEQ ID NO: 1515 - DNA, 20 bp, Artificial Sequence
  Synthetic DNA
agttgtcaaacaggcactcg

SEQ ID NO: 1516 - DNA, 22 bp, Artificial Sequence
  Synthetic DNA
aatgttgtccaggttctattgc

SEQ ID NO: 1517 - DNA, 28 bp, Artificial Sequence
  Synthetic DNA
aacaggcattttggacaacacattcttg

SEQ ID NO: 1518 - DNA, 19 bp, Artificial Sequence
  Synthetic DNA
caagcaaagggtggagttc

SEQ ID NO: 1519 - DNA, 21 bp, Artificial Sequence
  Synthetic DNA
cacagcttgcttgtcgatgtc

SEQ ID NO: 1520 - DNA, 21 bp, Artificial Sequence
  Synthetic DNA
ccttcgcctgcctctctgccc

SEQ ID NO: 1521 - DNA, 18 bp, Artificial Sequence
  Synthetic DNA
atgccggtcggtgatgag

SEQ ID NO: 1522 - DNA, 27 bp, Artificial Sequence
  Synthetic DNA
cgagactctcctcatagtgaaaggtat

SEQ ID NO: 1523 - DNA, 24 bp, Artificial Sequence
  Synthetic DNA
atgaccaccccggctcgtatgtca

SEQ ID NO: 1524 - DNA, 22 bp, Artificial Sequence
  Synthetic DNA
cttggcgtgtggaaatctacag

SEQ ID NO: 1525 - DNA, 20 bp, Artificial Sequence
  Synthetic DNA
cagctctctccacgcgattc

SEQ ID NO: 1526 - DNA, 28 bp, Artificial Sequence
  Synthetic DNA
caggatctaccccgagagagccactcat

SEQ ID NO: 1527 - DNA, 19 bp, Artificial Sequence
  Synthetic DNA
cccagcagctccattctga

SEQ ID NO: 1528 - DNA, 20 bp, Artificial Sequence
  Synthetic DNA
ctacagcctaaacggcaagg

SEQ ID NO: 1529 - DNA, 20 bp, Artificial Sequence
  Synthetic DNA
aggaccccaggacccagcag

SEQ ID NO: 1530 - DNA, 20 bp, Artificial Sequence
  Synthetic DNA
gttcccttcgaacagctttg

SEQ ID NO: 1531 - DNA, 20 bp, Artificial Sequence
  Synthetic DNA
agaaggactatgccgtccag

SEQ ID NO: 1532 - DNA, 24 bp, Artificial Sequence
  Synthetic DNA
atccacatcctgaaggcggacaag

SEQ ID NO: 1533 - DNA, 19 bp, Artificial Sequence
  Synthetic DNA
ccgtgaacttccaccagtc

SEQ ID NO: 1534 - DNA, 20 bp, Artificial Sequence
  Synthetic DNA
gcttccacatcgtggtattg

SEQ ID NO: 1535 - DNA, 27 bp, Artificial Sequence
  Synthetic DNA
cttctgataggtttcctcggcatcaga

SEQ ID NO: 1536 - DNA, 20 bp, Artificial Sequence
  Synthetic DNA
aactgcagggttgaaggact

SEQ ID NO: 1537 - DNA, 21 bp, Artificial Sequence
  Synthetic DNA
agagatcaccggcgtaatcaa

SEQ ID NO: 1538 - DNA, 27 bp, Artificial Sequence
  Synthetic DNA
ccagcgttggacaaatactttccgtca

SEQ ID NO: 1539 - DNA, 21 bp, Artificial Sequence
  Synthetic DNA
cgggctcagctatgattctca

SEQ ID NO: 1540 - DNA, 23 bp, Artificial Sequence
  Synthetic DNA
caaccgaagttttcactccagtt

SEQ ID NO: 1541 - DNA, 28 bp, Artificial Sequence
  Synthetic DNA
tccccacagtagacacatatgatggccg

SEQ ID NO: 1542 - DNA, 25 bp, Artificial Sequence
  Synthetic DNA
cctcagtccataaaccacactatca

SEQ ID NO: 1543 - DNA, 19 bp, Artificial Sequence
  Synthetic DNA
tccttgaccataccggagg

SEQ ID NO: 1544 - DNA, 24 bp, Artificial Sequence
  Synthetic DNA
tgcatgtacatctccggtgtccct

SEQ ID NO: 1545 - DNA, 20 bp, Artificial Sequence
  Synthetic DNA
cagtggcagtcttccctgtc

SEQ ID NO: 1546 - DNA, 20 bp, Artificial Sequence
  Synthetic DNA
gtttctgaaggggaggtcac

SEQ ID NO: 1547 - DNA, 24 bp, Artificial Sequence
  Synthetic DNA
ctgagctggcctcctatgcctcat

SEQ ID NO: 1548 - DNA, 19 bp, Artificial Sequence
  Synthetic DNA
aggtgtctggtttgggaca

SEQ ID NO: 1549 - DNA, 20 bp, Artificial Sequence
  Synthetic DNA
gctcatcatggtcatgtgct

SEQ ID NO: 1550 - DNA, 28 bp, Artificial Sequence
  Synthetic DNA
caggtctccttgatccactgacttttca

SEQ ID NO: 1551 - DNA, 20 bp, Artificial Sequence
  Synthetic DNA
tgtaagggtcagggatgtca

SEQ ID NO: 1552 - DNA, 19 bp, Artificial Sequence
  Synthetic DNA
ccctcgtgctgatgctact

SEQ ID NO: 1553 - DNA, 22 bp, Artificial Sequence
  Synthetic DNA
ctgccctagacgctggctcctc

SEQ ID NO: 1554 - DNA, 22 bp, Artificial Sequence
  Synthetic DNA
catcatgacctggtcttctagg

SEQ ID NO: 1555 - DNA, 19 bp, Artificial Sequence
  Synthetic DNA
gcggaaggtccctcagaca

SEQ ID NO: 1556 - DNA, 29 bp, Artificial Sequence
  Synthetic DNA
ctcagagcctctctggttctttcaatcgg

SEQ ID NO: 1557 - DNA, 24 bp, Artificial Sequence
  Synthetic DNA
tgatgatctaagtttcccgaggtt

SEQ ID NO: 1558 - DNA, 21 bp, Artificial Sequence
  Synthetic DNA
tggagactctcagggtcgaaa

SEQ ID NO: 1559 - DNA, 20 bp, Artificial Sequence
  Synthetic DNA
cggcggcagaccagcatgac

SEQ ID NO: 1560 - DNA, 22 bp, Artificial Sequence
  Synthetic DNA
ggcgtttggagtggtagaaatc

SEQ ID NO: 1561 - DNA, 21 bp, Artificial Sequence
  Synthetic DNA
cggtggaccacgaagagttaa

SEQ ID NO: 1562 - DNA, 23 bp, Artificial Sequence
  Synthetic DNA
ccgggacttggagaagcactgca

SEQ ID NO: 1563 - DNA, 19 bp, Artificial Sequence
  Synthetic DNA
ggctcgcctcttccatgtc

SEQ ID NO: 1564 - DNA, 20 bp, Artificial Sequence
  Synthetic DNA
ctttgaacccttgcttgcaa

SEQ ID NO: 1565 - DNA, 25 bp, Artificial Sequence
  Synthetic DNA
aagtcctgggtgcttctgacgcaca

SEQ ID NO: 1566 - DNA, 18 bp, Artificial Sequence
  Synthetic DNA
cccgggacaaagcaaatg

SEQ ID NO: 1567 - DNA, 20 bp, Artificial Sequence
  Synthetic DNA
cccagctagtgttcctcaga

SEQ ID NO: 1568 - DNA, 24 bp, Artificial Sequence
  Synthetic DNA
tcggccagctttttccaatctttg

SEQ ID NO: 1569 - DNA, 20 bp, Artificial Sequence
  Synthetic DNA
ccgtaagcccttcctctatg

SEQ ID NO: 1570 - DNA, 20 bp, Artificial Sequence
  Synthetic DNA
agcagtggcttgctttcttc

SEQ ID NO: 1571 - DNA, 25 bp, Artificial Sequence
  Synthetic DNA
cctgtgatgtcccagtttcccactc

SEQ ID NO: 1572 - DNA, 20 bp, Artificial Sequence
  Synthetic DNA
tgctaggaccatgttgggat

SEQ ID NO: 1573 - DNA, 19 bp, Artificial Sequence
  Synthetic DNA
ccgcaacgtggttttctca

SEQ ID NO: 1574 - DNA, 22 bp, Artificial Sequence
  Synthetic DNA
ctcggtgttggccatgctccag

SEQ ID NO: 1575 - DNA, 21 bp, Artificial Sequence
  Synthetic DNA
tgctgggtttctcctcctgtt

SEQ ID NO: 1576 - DNA, 20 bp, Artificial Sequence
  Synthetic DNA
gagctgtgggttgttatgga

SEQ ID NO: 1577 - DNA, 24 bp, Artificial Sequence
  Synthetic DNA
acatctgtcaaggagcctccagcc

SEQ ID NO: 1578 - DNA, 20 bp, Artificial Sequence
  Synthetic DNA
ccatgcaagtttctgtcacc

SEQ ID NO: 1579 - DNA, 20 bp, Artificial Sequence
  Synthetic DNA
ggagctgacctgcttcctac

SEQ ID NO: 1580 - DNA, 22 bp, Artificial Sequence
  Synthetic DNA
tccttatgcatcgaggccaggc

SEQ ID NO: 1581 - DNA, 20 bp, Artificial Sequence
  Synthetic DNA
agcagagcaccacagcatag

SEQ ID NO: 1582 - DNA, 20 bp, Artificial Sequence
  Synthetic DNA
aggtggctgtgttactgcaa

SEQ ID NO: 1583 - DNA, 25 bp, Artificial Sequence
  Synthetic DNA
tgccacagttctgcgacagtctacc

SEQ ID NO: 1584 - DNA, 20 bp, Artificial Sequence
  Synthetic DNA
cacctgtgtggtttcgtacc

SEQ ID NO: 1585 - DNA, 22 bp, Artificial Sequence
  Synthetic DNA
gaaggtgttggaggcactcaag

SEQ ID NO: 1586 - DNA, 24 bp, Artificial Sequence
  Synthetic DNA
atcccagcaggcctcgttgatgag

SEQ ID NO: 1587 - DNA, 21 bp, Artificial Sequence
  Synthetic DNA
ggtttacaccgctggagctaa

SEQ ID NO: 1588 - DNA, 19 bp, Artificial Sequence
  Synthetic DNA
ttgttggtgtgccctggtg

SEQ ID NO: 1589 - DNA, 22 bp, Artificial Sequence
  Synthetic DNA
tggtggcggtcactccctctgc

SEQ ID NO: 1590 - DNA, 21 bp, Artificial Sequence
  Synthetic DNA
tgggttctgtccaaacactgg

SEQ ID NO: 1591 - DNA, 20 bp, Artificial Sequence
  Synthetic DNA
actgaaggagacccttggag

SEQ ID NO: 1592 - DNA, 21 bp, Artificial Sequence
  Synthetic DNA
tctcctgccgatgcccctagg

SEQ ID NO: 1593 - DNA, 20 bp, Artificial Sequence
  Synthetic DNA
taaataaccctgcccacaca

SEQ ID NO: 1594 - DNA, 28 bp, Artificial Sequence
  Synthetic DNA
agttactaaaaaataccacgaggtcctt

SEQ ID NO: 1595 - DNA, 27 bp, Artificial Sequence
  Synthetic DNA
ccctgacaccggtctttggtctcaact

SEQ ID NO: 1596 - DNA, 21 bp, Artificial Sequence
  Synthetic DNA
gtcggtgagtgatttgtgcaa

SEQ ID NO: 1597 - DNA, 20 bp, Artificial Sequence
  Synthetic DNA
tatcgaggcaggtcatacca

SEQ ID NO: 1598 - DNA, 25 bp, Artificial Sequence
  Synthetic DNA
tccaggtcaacttttgacttccggt

SEQ ID NO: 1599 - DNA, 20 bp, Artificial Sequence
  Synthetic DNA
taacgcttggcatcatcatt

SEQ ID NO: 1600 - DNA, 20 bp, Artificial Sequence
  Synthetic DNA
gggagtttccaagagatgga

SEQ ID NO: 1601 - DNA, 23 bp, Artificial Sequence
  Synthetic DNA
cccaagacccgaccaagcactag

SEQ ID NO: 1602 - DNA, 20 bp, Artificial Sequence
  Synthetic DNA
cttcaaccaccttcccaaac

SEQ ID NO: 1603 - DNA, 20 bp, Artificial Sequence
  Synthetic DNA
ccagctctccttccagctac

SEQ ID NO: 1604 - DNA, 24 bp, Artificial Sequence
  Synthetic DNA
atcaatgtccctgtccgagtgctg

SEQ ID NO: 1605 - DNA, 20 bp, Artificial Sequence
  Synthetic DNA
gggtggctctcacttagctc

SEQ ID NO: 1606 - DNA, 20 bp, Artificial Sequence
  Synthetic DNA
ggaaaacgttcgtcaacatc

SEQ ID NO: 1607 - DNA, 23 bp, Artificial Sequence
  Synthetic DNA
caaccaggacacccacctcagct

SEQ ID NO: 1608 - DNA, 20 bp, Artificial Sequence
  Synthetic DNA
aaaacttgaccggtctttgc

SEQ ID NO: 1609 - DNA, 22 bp, Artificial Sequence
  Synthetic DNA
tctatacgtcgatggtgactgc

SEQ ID NO: 1610 - DNA, 24 bp, Artificial Sequence
  Synthetic DNA
ctccccaccttgactctttgtccg

SEQ ID NO: 1611 - DNA, 19 bp, Artificial Sequence
  Synthetic DNA
gccgacagccacattgtat

SEQ ID NO: 1612 - DNA, 24 bp, Artificial Sequence
  Synthetic DNA
agagccagttgctgtagaactcaa

SEQ ID NO: 1613 - DNA, 27 bp, Artificial Sequence
  Synthetic DNA
tctctgctgggcaaggatgttctgttc

SEQ ID NO: 1614 - DNA, 21 bp, Artificial Sequence
  Synthetic DNA
ctgggcctacacagtccttca

SEQ ID NO: 1615 - DNA, 18 bp, Artificial Sequence
  Synthetic DNA
tgctacctggacagcccg

SEQ ID NO: 1616 - DNA, 28 bp, Artificial Sequence
  Synthetic DNA
tcctcctgaaacgagctgtgtctgactt

SEQ ID NO: 1617 - DNA, 20 bp, Artificial Sequence
  Synthetic DNA
aggccgtccttcagtaacca

SEQ ID NO: 1618 - DNA, 21 bp, Artificial Sequence
  Synthetic DNA
ataccaatcaccgcacaaacc

SEQ ID NO: 1619 - DNA, 30 bp, Artificial Sequence
  Synthetic DNA
tgcgctgtgactggacttaacaaatagcct

SEQ ID NO: 1620 - DNA, 23 bp, Artificial Sequence
  Synthetic DNA
cacactagcattttctccgcata

SEQ ID NO: 1621 - DNA, 20 bp, Artificial Sequence
  Synthetic DNA
gtgattgaagagcatgccaa

SEQ ID NO: 1622 - DNA, 24 bp, Artificial Sequence
  Synthetic DNA
tcctgcttctcgggatacagacca

SEQ ID NO: 1623 - DNA, 18 bp, Artificial Sequence
  Synthetic DNA
gtcctgcgtgggaatagc

SEQ ID NO: 1624 - DNA, 20 bp, Artificial Sequence
  Synthetic DNA
ctgctcaaggacaccgtcta

SEQ ID NO: 1625 - DNA, 24 bp, Artificial Sequence
  Synthetic DNA
tacactcgggtcccatcgaagtcc

SEQ ID NO: 1626 - DNA, 18 bp, Artificial Sequence
  Synthetic DNA
ggatccactctggagggc

SEQ ID NO: 1627 - DNA, 20 bp, Artificial Sequence
  Synthetic DNA
gatcaacggctacatccaga

SEQ ID NO: 1628 - DNA, 25 bp, Artificial Sequence
  Synthetic DNA
tcaaagtcctcctctcccgacttga

SEQ ID NO: 1629 - DNA, 20 bp, Artificial Sequence
  Synthetic DNA
tgaactgtgaggccagagac

SEQ ID NO: 1630 - DNA, 19 bp, Artificial Sequence
  Synthetic DNA
cagcaccagcgattacgac

SEQ ID NO: 1631 - DNA, 24 bp, Artificial Sequence
  Synthetic DNA
agccattgtgaggactctcccagc

SEQ ID NO: 1632 - DNA, 18 bp, Artificial Sequence
  Synthetic DNA
ctgaataggcccacgtcc

SEQ ID NO: 1633 - DNA, 20 bp, Artificial Sequence
  Synthetic DNA
ccgcctggacattgattcac

SEQ ID NO: 1634 - DNA, 23 bp, Artificial Sequence
  Synthetic DNA
acccatcacagcccggaacactg

SEQ ID NO: 1635 - DNA, 21 bp, Artificial Sequence
  Synthetic DNA
ctgggccaatggtacagatga

SEQ ID NO: 1636 - DNA, 19 bp, Artificial Sequence
  Synthetic DNA
gcatccctcacccatccta

SEQ ID NO: 1637 - DNA, 24 bp, Artificial Sequence
  Synthetic DNA
aggccaggcaggagcccttctata

SEQ ID NO: 1638 - DNA, 20 bp, Artificial Sequence
  Synthetic DNA
gctggaaatctgctggatgt

SEQ ID NO: 1639 - DNA, 20 bp, Artificial Sequence
  Synthetic DNA
cccatggatgctcctctgaa

SEQ ID NO: 1640 - DNA, 22 bp, Artificial Sequence
  Synthetic DNA
cattgactgccgaggccccatg

SEQ ID NO: 1641 - DNA, 20 bp, Artificial Sequence
  Synthetic DNA
ccggtggctaccagacattg

SEQ ID NO: 1642 - DNA, 26 bp, Artificial Sequence
  Synthetic DNA
aatgaatacagtattcccaagcacat

SEQ ID NO: 1643 - DNA, 18 bp, Artificial Sequence
  Synthetic DNA
aaccccgtggccgcctcc

SEQ ID NO: 1644 - DNA, 23 bp, Artificial Sequence
  Synthetic DNA
tgtctgaagcatcttctggatga

SEQ ID NO: 1645 - DNA, 19 bp, Artificial Sequence
  Synthetic DNA
tgaaggagacgtaccgctg

SEQ ID NO: 1646 - DNA, 24 bp, Artificial Sequence
  Synthetic DNA
caagcaggttcactacacgctgcc

SEQ ID NO: 1647 - DNA, 18 bp, Artificial Sequence
  Synthetic DNA
caggcagtgagaggctgg

SEQ ID NO: 1648 - DNA, 19 bp, Artificial Sequence
  Synthetic DNA
cagggaggtggttgcaaat

SEQ ID NO: 1649 - DNA, 24 bp, Artificial Sequence
  Synthetic DNA
tccagccttttcgtggtgactcaa

SEQ ID NO: 1650 - DNA, 19 bp, Artificial Sequence
  Synthetic DNA
tctcccaggatgcatgaag

SEQ ID NO: 1651 - DNA, 21 bp, Artificial Sequence
  Synthetic DNA
cttacggttttcgtggagaag

SEQ ID NO: 1652 - DNA, 29 bp, Artificial Sequence
  Synthetic DNA
cctcagctatacaacaaattgaccccaag

SEQ ID NO: 1653 - DNA, 20 bp, Artificial Sequence
  Synthetic DNA
agcagccgttcttgttgtaa

SEQ ID NO: 1654 - DNA, 20 bp, Artificial Sequence
  Synthetic DNA
gatgtggactgccattcaaa

SEQ ID NO: 1655 - DNA, 28 bp, Artificial Sequence
  Synthetic DNA
tcgaaatttacatccggtatcttcctgg

SEQ ID NO: 1656 - DNA, 20 bp, Artificial Sequence
  Synthetic DNA
tgcgagattagttggctgag

SEQ ID NO: 1657 - DNA, 21 bp, Artificial Sequence
  Synthetic DNA
tgactttatggagcccaagtt

SEQ ID NO: 1658 - DNA, 25 bp, Artificial Sequence
  Synthetic DNA
ttccagtgcattgaacttcacagca

SEQ ID NO: 1659 - DNA, 20 bp, Artificial Sequence
  Synthetic DNA
gccaagtcgctgtcatctaa

SEQ ID NO: 1660 - DNA, 20 bp, Artificial Sequence
  Synthetic DNA
tcctcatttggatgggaaac

SEQ ID NO: 1661 - DNA, 29 bp, Artificial Sequence
  Synthetic DNA
ttcctttaattacttggccaaacaccaca

SEQ ID NO: 1662 - DNA, 21 bp, Artificial Sequence
  Synthetic DNA
ccaatatccttgccactccta

SEQ ID NO: 1663 - DNA, 18 bp, Artificial Sequence
  Synthetic DNA
gccatccgcaaaggcttt

SEQ ID NO: 1664 - DNA, 23 bp, Artificial Sequence
  Synthetic DNA
tcgcttgtcaccttgccatgtgg

SEQ ID NO: 1665 - DNA, 18 bp, Artificial Sequence
  Synthetic DNA
ggccattccgccagtttc

SEQ ID NO: 1666 - DNA, 20 bp, Artificial Sequence
  Synthetic DNA
ggctcagagcataaggcttc

SEQ ID NO: 1667 - DNA, 24 bp, Artificial Sequence
  Synthetic DNA
ttggtcacttctcccaacttgggc

SEQ ID NO: 1668 - DNA, 20 bp, Artificial Sequence
  Synthetic DNA
acgggaactcagaaaactgg

SEQ ID NO: 1669 - DNA, 20 bp, Artificial Sequence
  Synthetic DNA
gcatcaggctgtcattatgg

SEQ ID NO: 1670 - DNA, 28 bp, Artificial Sequence
  Synthetic DNA
tgtccttacctgtgggagctgtaaggtc

SEQ ID NO: 1671 - DNA, 20 bp, Artificial Sequence
  Synthetic DNA
agtagttgtgctgcccttcc

SEQ ID NO: 1672 - DNA, 20 bp, Artificial Sequence
  Synthetic DNA
ggtgtccttcgccagatcac

SEQ ID NO: 1673 - DNA, 26 bp, Artificial Sequence
  Synthetic DNA
ttaatgatttgcctgtgggacgctcc

SEQ ID NO: 1674 - DNA, 18 bp, Artificial Sequence
  Synthetic DNA
cagccgcagagcctcatc

SEQ ID NO: 1675 - DNA, 20 bp, Artificial Sequence
  Synthetic DNA
tgaccccaatggagtcatca

SEQ ID NO: 1676 - DNA, 27 bp, Artificial Sequence
  Synthetic DNA
catttgagcgtcaacgatctcccagtg

SEQ ID NO: 1677 - DNA, 19 bp, Artificial Sequence
  Synthetic DNA
ccaagcggagggtttcttc

SEQ ID NO: 1678 - DNA, 22 bp, Artificial Sequence
  Synthetic DNA
ttacccatttggcctggattaa

SEQ ID NO: 1679 - DNA, 26 bp, Artificial Sequence
  Synthetic DNA
ccaagtcctccttgtcttcgaggggt

SEQ ID NO: 1680 - DNA, 25 bp, Artificial Sequence
  Synthetic DNA
ctgaaagaagtggaatccttattgg

SEQ ID NO: 1681 - DNA, 20 bp, Artificial Sequence
  Synthetic DNA
ctgtgagccagaggatgtca

SEQ ID NO: 1682 - DNA, 24 bp, Artificial Sequence
  Synthetic DNA
ctgccaattgtgttttcctgcagc

SEQ ID NO: 1683 - DNA, 20 bp, Artificial Sequence
  Synthetic DNA
tgtgatgacaccaggatgtg

SEQ ID NO: 1684 - DNA, 21 bp, Artificial Sequence
  Synthetic DNA
caagcaatgcgtcatcaatgt

SEQ ID NO: 1685 - DNA, 25 bp, Artificial Sequence
  Synthetic DNA
cagcctctgcggaatggatcacact

SEQ ID NO: 1686 - DNA, 20 bp, Artificial Sequence
  Synthetic DNA
gtaaatccgccccctcttct

SEQ ID NO: 1687 - DNA, 18 bp, Artificial Sequence
  Synthetic DNA
gacccagctccactcctg

SEQ ID NO: 1688 - DNA, 24 bp, Artificial Sequence
  Synthetic DNA
ccagaccatggaccgcctgtactt

SEQ ID NO: 1689 - DNA, 20 bp, Artificial Sequence
  Synthetic DNA
cccattcacgtactccatca

SEQ ID NO: 1690 - DNA, 20 bp, Artificial Sequence
  Synthetic DNA
ctgacacttgccgcagagaa

SEQ ID NO: 1691 - DNA, 26 bp, Artificial Sequence
  Synthetic DNA
ccctttctcacccacctcatctgcac

SEQ ID NO: 1692 - DNA, 20 bp, Artificial Sequence
  Synthetic DNA
aggtggtccttggtctggaa

SEQ ID NO: 1693 - DNA, 21 bp, Artificial Sequence
  Synthetic DNA
gcgatacatgagcccagaaca

SEQ ID NO: 1694 - DNA, 29 bp, Artificial Sequence
  Synthetic DNA
aggtccacttcctttccatagtcttgcga

SEQ ID NO: 1695 - DNA, 22 bp, Artificial Sequence
  Synthetic DNA
tcagcaagaattagccccaaag

SEQ ID NO: 1696 - DNA, 19 bp, Artificial Sequence
  Synthetic DNA
gccctcccagtgtgcaaat

SEQ ID NO: 1697 - DNA, 23 bp, Artificial Sequence
  Synthetic DNA
tgctgtttcgacgacaccgttcg

SEQ ID NO: 1698 - DNA, 25 bp, Artificial Sequence
  Synthetic DNA
cgtcgatggtattaggatagaagca

SEQ ID NO: 1699 - DNA, 19 bp, Artificial Sequence
  Synthetic DNA
ccacgacaaagccgactac

SEQ ID NO: 1700 - DNA, 24 bp, Artificial Sequence
  Synthetic DNA
cctgaaacaaggctgagaatcccg

SEQ ID NO: 1701 - DNA, 19 bp, Artificial Sequence
  Synthetic DNA
tactcgatgggctctgctg

SEQ ID NO: 1702 - DNA, 25 bp, Artificial Sequence
  Synthetic DNA
tggctaagtgaagatgacaatcatg

SEQ ID NO: 1703 - DNA, 29 bp, Artificial Sequence
  Synthetic DNA
cctttccagctttacagtgaattgctgca

SEQ ID NO: 1704 - DNA, 25 bp, Artificial Sequence
  Synthetic DNA
tgcacatatcattacaccagttcgt

SEQ ID NO: 1705 - DNA, 20 bp, Artificial Sequence
  Synthetic DNA
taactggggcaaccttttct

SEQ ID NO: 1706 - DNA, 22 bp, Artificial Sequence
  Synthetic DNA
cctttgccttcctggggctctt

SEQ ID NO: 1707 - DNA, 20 bp, Artificial Sequence
  Synthetic DNA
ttgcaggaaaaggtgactgt

SEQ ID NO: 1708 - DNA, 22 bp, Artificial Sequence
  Synthetic DNA
agtgactgggagtgggctagaa

SEQ ID NO: 1709 - DNA, 24 bp, Artificial Sequence
  Synthetic DNA
tgacacctccacaacgtcgctgga

SEQ ID NO: 1710 - DNA, 21 bp, Artificial Sequence
  Synthetic DNA
aagcctgttaccgtgaatcga

SEQ ID NO: 1711 - DNA, 24 bp, Artificial Sequence
  Synthetic DNA
cgaggtacaagctgagatcaagaa

SEQ ID NO: 1712 - DNA, 22 bp, Artificial Sequence
  Synthetic DNA
ccagtgccagtgtccagcggct

SEQ ID NO: 1713 - DNA, 18 bp, Artificial Sequence
  Synthetic DNA
gcgtgcctttcgcttgaa

SEQ ID NO: 1714 - DNA, 20 bp, Artificial Sequence
  Synthetic DNA
gaccggtcgaatgataaggt

SEQ ID NO: 1715 - DNA, 24 bp, Artificial Sequence
  Synthetic DNA
accaggcccgtcacattctcgtac

SEQ ID NO: 1716 - DNA, 20 bp, Artificial Sequence
  Synthetic DNA
ctggacatctcgatgacagc

SEQ ID NO: 1717 - DNA, 19 bp, Artificial Sequence
  Synthetic DNA
caagcccagccgacctaag

SEQ ID NO: 1718 - DNA, 23 bp, Artificial Sequence
  Synthetic DNA
ctccgcaaaccaacctcctggct

SEQ ID NO: 1719 - DNA, 21 bp, Artificial Sequence
  Synthetic DNA
gaacctggaactgcagctttg

SEQ ID NO: 1720 - DNA, 20 bp, Artificial Sequence
  Synthetic DNA
cctgttctcggcaccttaaa

SEQ ID NO: 1721 - DNA, 24 bp, Artificial Sequence
  Synthetic DNA
acctgactgccccggggtctaata

SEQ ID NO: 1722 - DNA, 18 bp, Artificial Sequence
  Synthetic DNA
tattgccttcgggtgtcc

SEQ ID NO: 1723 - DNA, 20 bp, Artificial Sequence
  Synthetic DNA
aatatttgtgcggggtatgg

SEQ ID NO: 1724 - DNA, 29 bp, Artificial Sequence
  Synthetic DNA
ccaagagaaacgagatttaaaaacccacc

SEQ ID NO: 1725 - DNA, 20 bp, Artificial Sequence
  Synthetic DNA
aacgagatccctgtgcttgt

SEQ ID NO: 1726 - DNA, 23 bp, Artificial Sequence
  Synthetic DNA
cgcttgcctaactcatactttcc

SEQ ID NO: 1727 - DNA, 19 bp, Artificial Sequence
  Synthetic DNA
tccacgcagcgtggcactg

SEQ ID NO: 1728 - DNA, 20 bp, Artificial Sequence
  Synthetic DNA
ccattcagactgcgccactt

SEQ ID NO: 1729 - DNA, 20 bp, Artificial Sequence
  Synthetic DNA
aatgaggaagtttcggatgg

SEQ ID NO: 1730 - DNA, 23 bp, Artificial Sequence
  Synthetic DNA
ctgatccagacagccgaccagct

SEQ ID NO: 1731 - DNA, 20 bp, Artificial Sequence
  Synthetic DNA
cttcgatcacagccaggtag

SEQ ID NO: 1732 - DNA, 20 bp, Artificial Sequence
  Synthetic DNA
tgttttagctgagggacgtg

SEQ ID NO: 1733 - DNA, 24 bp, Artificial Sequence
  Synthetic DNA
ccgacgtccccaaacctagctagg

SEQ ID NO: 1734 - DNA, 20 bp, Artificial Sequence
  Synthetic DNA
taccaaccctggaatgttga

SEQ ID NO: 1735 - DNA, 21 bp, Artificial Sequence
  Synthetic DNA
aacttccggtacctcgttcgt

SEQ ID NO: 1736 - DNA, 29 bp, Artificial Sequence
  Synthetic DNA
actacatgaagcagagtcctcccgaatcg

SEQ ID NO: 1737 - DNA, 20 bp, Artificial Sequence
  Synthetic DNA
agcactgcaatgcaccagaa

SEQ ID NO: 1738 - DNA, 19 bp, Artificial Sequence
  Synthetic DNA
catggcctgatcatggtgt

SEQ ID NO: 1739 - DNA, 24 bp, Artificial Sequence
  Synthetic DNA
cccacagcaaatgctgcagaaagt

SEQ ID NO: 1740 - DNA, 21 bp, Artificial Sequence
  Synthetic DNA
ccatgtgtacaaactgcagga

SEQ ID NO: 1741 - DNA, 28 bp, Artificial Sequence
  Synthetic DNA
ggctactctgatctatgttgataaggaa

SEQ ID NO: 1742 - DNA, 22 bp, Artificial Sequence
  Synthetic DNA
cacacgggtgcctggttctcca

SEQ ID NO: 1743 - DNA, 20 bp, Artificial Sequence
  Synthetic DNA
gcttcagcccatccttagca

SEQ ID NO: 1744 - DNA, 18 bp, Artificial Sequence
  Synthetic DNA
cctgcagctgtgggacat

SEQ ID NO: 1745 - DNA, 24 bp, Artificial Sequence
  Synthetic DNA
cgatttggcaacatgacccgagta

SEQ ID NO: 1746 - DNA, 19 bp, Artificial Sequence
  Synthetic DNA
agcaccaacagcttccttg

SEQ ID NO: 1747 - DNA, 21 bp, Artificial Sequence
  Synthetic DNA
gcgacagctcctctagttcca

SEQ ID NO: 1748 - DNA, 19 bp, Artificial Sequence
  Synthetic DNA
ttcccgaagtctccgcccg

SEQ ID NO: 1749 - DNA, 22 bp, Artificial Sequence
  Synthetic DNA
ggaacaccagcttgaatttcct

SEQ ID NO: 1750 - DNA, 21 bp, Artificial Sequence
  Synthetic DNA
tgttgtaaatgtctcagcccc

SEQ ID NO: 1751 - DNA, 23 bp, Artificial Sequence
  Synthetic DNA
cgttcttggtcctgtcccttgga

SEQ ID NO: 1752 - DNA, 20 bp, Artificial Sequence
  Synthetic DNA
ttgagcaaagcgtacaaagg

SEQ ID NO: 1753 - DNA, 24 bp, Artificial Sequence
  Synthetic DNA
gaacttcttgagcaggagcatacc

SEQ ID NO: 1754 - DNA, 25 bp, Artificial Sequence
  Synthetic DNA
agggcttcataatcaccttctgttc

SEQ ID NO: 1755 - DNA, 25 bp, Artificial Sequence
  Synthetic DNA
tccacccccaagaatatcatctagt

SEQ ID NO: 1756 - DNA, 23 bp, Artificial Sequence
  Synthetic DNA
agctagcctcagtgacacacatg

SEQ ID NO: 1757 - DNA, 24 bp, Artificial Sequence
  Synthetic DNA
acacaacgtcggcagtgcaacctg

SEQ ID NO: 1758 - DNA, 18 bp, Artificial Sequence
  Synthetic DNA
ccggatctgacggctgtt

SEQ ID NO: 1759 - DNA, 20 bp, Artificial Sequence
  Synthetic DNA
cgtcgtatgcgagagtctgt

SEQ ID NO: 1760 - DNA, 26 bp, Artificial Sequence
  Synthetic DNA
tccaggatgcctgttagttctcagca

SEQ ID NO: 1761 - DNA, 20 bp, Artificial Sequence
  Synthetic DNA
tgaaggcgtgaggtgtagaa

SEQ ID NO: 1762 - DNA, 26 bp, Artificial Sequence
  Synthetic DNA
ggtgtcagatataaatgtgcaaatgc

SEQ ID NO: 1763 - DNA, 28 bp, Artificial Sequence
  Synthetic DNA
tgctgtcctgtcggtctcagtacgttca

SEQ ID NO: 1764 - DNA, 24 bp, Artificial Sequence
  Synthetic DNA
ttcgatattgccagcagctataaa

SEQ ID NO: 1765 - DNA, 20 bp, Artificial Sequence
  Synthetic DNA
tccttcagctttcacactgg

SEQ ID NO: 1766 - DNA, 29 bp, Artificial Sequence
  Synthetic DNA
tccagaagagtcatgcaacttcatttctg

SEQ ID NO: 1767 - DNA, 20 bp, Artificial Sequence
  Synthetic DNA
aaatcctgttcccacctgac

SEQ ID NO: 1768 - DNA, 20 bp, Artificial Sequence
  Synthetic DNA
aacatgattatccaagccgc

SEQ ID NO: 1769 - DNA, 24 bp, Artificial Sequence
  Synthetic DNA
aagccaattttgtccacaatggca

SEQ ID NO: 1770 - DNA, 20 bp, Artificial Sequence
  Synthetic DNA
gccaacaagcactgttatcg

SEQ ID NO: 1771 - DNA, 22 bp, Artificial Sequence
  Synthetic DNA
caagtcagttgagacgccagtt

SEQ ID NO: 1772 - DNA, 25 bp, Artificial Sequence
  Synthetic DNA
ttctatggcggcctgacttcctcca

SEQ ID NO: 1773 - DNA, 20 bp, Artificial Sequence
  Synthetic DNA
tgcagctctcgtccaaagtg

SEQ ID NO: 1774 - DNA, 20 bp, Artificial Sequence
  Synthetic DNA
tgtggatgctggattgattt

SEQ ID NO: 1775 - DNA, 25 bp, Artificial Sequence
  Synthetic DNA
ccactggtgcagctgctaaatagca

SEQ ID NO: 1776 - DNA, 20 bp, Artificial Sequence
  Synthetic DNA
aagcagcacttcctggtctt

SEQ ID NO: 1777 - DNA, 23 bp, Artificial Sequence
  Synthetic DNA
agtctgtgagaaacgaccgaaac

SEQ ID NO: 1778 - DNA, 23 bp, Artificial Sequence
  Synthetic DNA
tcgggcttgggcacctccttctt

SEQ ID NO: 1779 - DNA, 18 bp, Artificial Sequence
  Synthetic DNA
cggcgtcagcgtgtagct

SEQ ID NO: 1780 - DNA, 20 bp, Artificial Sequence
  Synthetic DNA
tgcctggacatcctgattct

SEQ ID NO: 1781 - DNA, 26 bp, Artificial Sequence
  Synthetic DNA
tgcaccaggtataccccagaacaaga

SEQ ID NO: 1782 - DNA, 20 bp, Artificial Sequence
  Synthetic DNA
aaggccgtctgagaaagtca

SEQ ID NO: 1783 - DNA, 20 bp, Artificial Sequence
  Synthetic DNA
agtgggagacacctgacctt

SEQ ID NO: 1784 - DNA, 29 bp, Artificial Sequence
  Synthetic DNA
ttgatcttctgctcaatctcagcttgaga

SEQ ID NO: 1785 - DNA, 20 bp, Artificial Sequence
  Synthetic DNA
tgatctgggcattgtactcc

SEQ ID NO: 1786 - DNA, 21 bp, Artificial Sequence
  Synthetic DNA
cgagagggagagcaagaccat

SEQ ID NO: 1787 - DNA, 19 bp, Artificial Sequence
  Synthetic DNA
ctgcgcggccttcccatca

SEQ ID NO: 1788 - DNA, 24 bp, Artificial Sequence
  Synthetic DNA
tctcgaatatcgctctctgtgatg

SEQ ID NO: 1789 - DNA, 23 bp, Artificial Sequence
  Synthetic DNA
ggaaccacattatggatctttgc

SEQ ID NO: 1790 - DNA, 28 bp, Artificial Sequence
  Synthetic DNA
tagaatgtcaagctaaccaggcgtccgc

SEQ ID NO: 1791 - DNA, 24 bp, Artificial Sequence
  Synthetic DNA
catgcgacagtacactcttctgaa

SEQ ID NO: 1792 - DNA, 18 bp, Artificial Sequence
  Synthetic DNA
gggctgggtgagaatgtg

SEQ ID NO: 1793 - DNA, 24 bp, Artificial Sequence
  Synthetic DNA
ataccagggccggcttcttcctct

SEQ ID NO: 1794 - DNA, 19 bp, Artificial Sequence
  Synthetic DNA
cacaacatcctccggaatg

SEQ ID NO: 1795 - DNA, 19 bp, Artificial Sequence
  Synthetic DNA
tgctaactcctgcacagcc

SEQ ID NO: 1796 - DNA, 25 bp, Artificial Sequence
  Synthetic DNA
tcctcttcctttctgctagcctggc

SEQ ID NO: 1797 - DNA, 20 bp, Artificial Sequence
  Synthetic DNA
tgctaggtttcccctctgaa

SEQ ID NO: 1798 - DNA, 25 bp, Artificial Sequence
  Synthetic DNA
tcaagaccatcatcactttcattgt

SEQ ID NO: 1799 - DNA, 21 bp, Artificial Sequence
  Synthetic DNA
cctcccggtccgcaagcagtt

SEQ ID NO: 1800 - DNA, 27 bp, Artificial Sequence
  Synthetic DNA
ggatcaggaagtacacggagtataact

SEQ ID NO: 1801 - DNA, 21 bp, Artificial Sequence
  Synthetic DNA
aagcatgaacaggacttgacc

SEQ ID NO: 1802 - DNA, 24 bp, Artificial Sequence
  Synthetic DNA
ctttccaacccctggggaagacat

SEQ ID NO: 1803 - DNA, 18 bp, Artificial Sequence
  Synthetic DNA
cctccccaagtcagttgc

SEQ ID NO: 1804 - DNA, 18 bp, Artificial Sequence
  Synthetic DNA
cccgttcggtctgaggaa

SEQ ID NO: 1805 - DNA, 19 bp, Artificial Sequence
  Synthetic DNA
tccggttcgccatgtcccg

SEQ ID NO: 1806 - DNA, 22 bp, Artificial Sequence
  Synthetic DNA
gagcactcaaggtagccaaagg

SEQ ID NO: 1807 - DNA, 20 bp, Artificial Sequence
  Synthetic DNA
ccagacgagcgattagaagc

SEQ ID NO: 1808 - DNA, 23 bp, Artificial Sequence
  Synthetic DNA
tgtgaggtgaatgatttggggga

SEQ ID NO: 1809 - DNA, 20 bp, Artificial Sequence
  Synthetic DNA
tcctcctcttcctcctcctc

SEQ ID NO: 1810 - DNA, 20 bp, Artificial Sequence
  Synthetic DNA
accctggaagagatggatca

SEQ ID NO: 1811 - DNA, 26 bp, Artificial Sequence
  Synthetic DNA
ccatcatacagatcacacactcccgg

SEQ ID NO: 1812 - DNA, 20 bp, Artificial Sequence
  Synthetic DNA
attgggtccccataaacaaa

SEQ ID NO: 1813 - DNA, 22 bp, Artificial Sequence
  Synthetic DNA
tgtgcacataggaatgagcttc

SEQ ID NO: 1814 - DNA, 24 bp, Artificial Sequence
  Synthetic DNA
tcactctctttgctggccaactgc

SEQ ID NO: 1815 - DNA, 20 bp, Artificial Sequence
  Synthetic DNA
gtttagcacgcaattgctca

SEQ ID NO: 1816 - DNA, 18 bp, Artificial Sequence
  Synthetic DNA
gatccgagaccctcgctc

SEQ ID NO: 1817 - DNA, 23 bp, Artificial Sequence
  Synthetic DNA
cccatcaacgtggagagcttgct

SEQ ID NO: 1818 - DNA, 21 bp, Artificial Sequence
  Synthetic DNA
aggaccaaggaatttaagcca

SEQ ID NO: 1819 - DNA, 24 bp, Artificial Sequence
  Synthetic DNA
ccattctatcatcaacgggtacaa

SEQ ID NO: 1820 - DNA, 25 bp, Artificial Sequence
  Synthetic DNA
tctccacagacaaggccaggactcg

SEQ ID NO: 1821 - DNA, 23 bp, Artificial Sequence
  Synthetic DNA
tcagcaagtgggaaggtgtaatc

SEQ ID NO: 1822 - DNA, 20 bp, Artificial Sequence
  Synthetic DNA
cagtcggctttaccctatcg

SEQ ID NO: 1823 - DNA, 24 bp, Artificial Sequence
  Synthetic DNA
caacttcaaccaagtggggacgct

SEQ ID NO: 1824 - DNA, 19 bp, Artificial Sequence
  Synthetic DNA
tctgctccttcacgtcgtc

SEQ ID NO: 1825 - DNA, 20 bp, Artificial Sequence
  Synthetic DNA
gggctactggcagctacatt

SEQ ID NO: 1826 - DNA, 25 bp, Artificial Sequence
  Synthetic DNA
cattggaattgccattagtcccagc

SEQ ID NO: 1827 - DNA, 20 bp, Artificial Sequence
  Synthetic DNA
ctctcagcatcggtacaagg

SEQ ID NO: 1828 - DNA, 20 bp, Artificial Sequence
  Synthetic DNA
cagcgggattaaacagtcct

SEQ ID NO: 1829 - DNA, 25 bp, Artificial Sequence
  Synthetic DNA
ccagcacagccagttaaaagatgca

SEQ ID NO: 1830 - DNA, 20 bp, Artificial Sequence
  Synthetic DNA
atctgcgttgaagcagtgag

SEQ ID NO: 1831 - DNA, 20 bp, Artificial Sequence
  Synthetic DNA
gactggagtggtgtttggtg

SEQ ID NO: 1832 - DNA, 26 bp, Artificial Sequence
  Synthetic DNA
ccagcctattcctgctgctttcattg

SEQ ID NO: 1833 - DNA, 20 bp, Artificial Sequence
  Synthetic DNA
ctgttacgctcacaatgctg

SEQ ID NO: 1834 - DNA, 20 bp, Artificial Sequence
  Synthetic DNA
aacagagacattgccaacca

SEQ ID NO: 1835 - DNA, 24 bp, Artificial Sequence
  Synthetic DNA
ttggatctgcttgctgtccaaacc

SEQ ID NO: 1836 - DNA, 20 bp, Artificial Sequence
  Synthetic DNA
gtgatttgcccaggaagttt

SEQ ID NO: 1837 - DNA, 20 bp, Artificial Sequence
  Synthetic DNA
gctctgttgtgtcctgttgc

SEQ ID NO: 1838 - DNA, 23 bp, Artificial Sequence
  Synthetic DNA
tcagtcacaggaaggccagagcc

SEQ ID NO: 1839 - DNA, 21 bp, Artificial Sequence
  Synthetic DNA
gtacggagaagccacttcaca

SEQ ID NO: 1840 - DNA, 20 bp, Artificial Sequence
  Synthetic DNA
tggacaaggtgatgaaggag

SEQ ID NO: 1841 - DNA, 24 bp, Artificial Sequence
  Synthetic DNA
cctccccgtctccattctcgtcta

SEQ ID NO: 1842 - DNA, 20 bp, Artificial Sequence
  Synthetic DNA
agcaccacatactcctggaa

SEQ ID NO: 1843 - DNA, 21 bp, Artificial Sequence
  Synthetic DNA
tggctgtgctggtcactacct

SEQ ID NO: 1844 - DNA, 27 bp, Artificial Sequence
  Synthetic DNA
cacaagtactcctgccaagagggcgac

SEQ ID NO: 1845 - DNA, 22 bp, Artificial Sequence
  Synthetic DNA
tcccccttactcagcttgaact

SEQ ID NO: 1846 - DNA, 18 bp, Artificial Sequence
  Synthetic DNA
gactgctgtcatggcgtg

SEQ ID NO: 1847 - DNA, 24 bp, Artificial Sequence
  Synthetic DNA
atcacatccagggccttctccaga

SEQ ID NO: 1848 - DNA, 22 bp, Artificial Sequence
  Synthetic DNA
cgagtacttgtggaaggtggac

SEQ ID NO: 1849 - DNA, 22 bp, Artificial Sequence
  Synthetic DNA
actccctgataaaggggaattt

SEQ ID NO: 1850 - DNA, 24 bp, Artificial Sequence
  Synthetic DNA
catgccgtctacagggatgacctg

SEQ ID NO: 1851 - DNA, 21 bp, Artificial Sequence
  Synthetic DNA
tgaggacactcggtctctagc

SEQ ID NO: 1852 - DNA, 20 bp, Artificial Sequence
  Synthetic DNA
ctttgggacagagtgcaaga

SEQ ID NO: 1853 - DNA, 24 bp, Artificial Sequence
  Synthetic DNA
cgatgacttgcaaaatgtcgcagc

SEQ ID NO: 1854 - DNA, 20 bp, Artificial Sequence
  Synthetic DNA
tggtctctatgttgcgttcc

SEQ ID NO: 1855 - DNA, 21 bp, Artificial Sequence
  Synthetic DNA
agacaaggatgccgtggataa

SEQ ID NO: 1856 - DNA, 23 bp, Artificial Sequence
  Synthetic DNA
ttgctcaaggacctggacgccaa

SEQ ID NO: 1857 - DNA, 20 bp, Artificial Sequence
  Synthetic DNA
gaagtccacctgggcatctc

SEQ ID NO: 1858 - DNA, 20 bp, Artificial Sequence
  Synthetic DNA
ccttttaccactgcctggtt

SEQ ID NO: 1859 - DNA, 24 bp, Artificial Sequence
  Synthetic DNA
tccagtgctctttcggcacttctg

SEQ ID NO: 1860 - DNA, 19 bp, Artificial Sequence
  Synthetic DNA
acaatgctgtgtccttccg

SEQ ID NO: 1861 - DNA, 18 bp, Artificial Sequence
  Synthetic DNA
ggactcaacgatgggcag

SEQ ID NO: 1862 - DNA, 24 bp, Artificial Sequence
  Synthetic DNA
ccctgtctgcacctcccagatctt

SEQ ID NO: 1863 - DNA, 20 bp, Artificial Sequence
  Synthetic DNA
cggaaagattcaaaagcagg

SEQ ID NO: 1864 - DNA, 20 bp, Artificial Sequence
  Synthetic DNA
gaaattgacgaggggtgtct

SEQ ID NO: 1865 - DNA, 22 bp, Artificial Sequence
  Synthetic DNA
ctctgagcgcctccatccaagg

SEQ ID NO: 1866 - DNA, 20 bp, Artificial Sequence
  Synthetic DNA
aggagctaacggagaacctg

SEQ ID NO: 1867 - DNA, 22 bp, Artificial Sequence
  Synthetic DNA
gctccaggatgtgtttctgttg

SEQ ID NO: 1868 - DNA, 18 bp, Artificial Sequence
  Synthetic DNA
tcgcgggaccaccggacc

SEQ ID NO: 1869 - DNA, 21 bp, Artificial Sequence
  Synthetic DNA
acgtggagaagacggcataga

SEQ ID NO: 1870 - DNA, 20 bp, Artificial Sequence
  Synthetic DNA
cgcgagcccctcattataca

SEQ ID NO: 1871 - DNA, 22 bp, Artificial Sequence
  Synthetic DNA
ctccccacagcgcatcgaggaa

SEQ ID NO: 1872 - DNA, 19 bp, Artificial Sequence
  Synthetic DNA
cactcgccgttgacatcct

SEQ ID NO: 1873 - DNA, 20 bp, Artificial Sequence
  Synthetic DNA
ttccagcccaacacagtgaa

SEQ ID NO: 1874 - DNA, 22 bp, Artificial Sequence
  Synthetic DNA
actttggcctgcccgctcctct

SEQ ID NO: 1875 - DNA, 18 bp, Artificial Sequence
  Synthetic DNA
gagtcgggtcgccaggtt

SEQ ID NO: 1876 - DNA, 19 bp, Artificial Sequence
  Synthetic DNA
caagctgaacggtgtgtcc

SEQ ID NO: 1877 - DNA, 24 bp, Artificial Sequence
  Synthetic DNA
cagcaccgatttcttcaggtccct

SEQ ID NO: 1878 - DNA, 19 bp, Artificial Sequence
  Synthetic DNA
tgcaagctgtctttgagcc

SEQ ID NO: 1879 - DNA, 18 bp, Artificial Sequence
  Synthetic DNA
tacaggatgaggctgggc

SEQ ID NO: 1880 - DNA, 24 bp, Artificial Sequence
  Synthetic DNA
cctgggacagcctatgtaaggcca

SEQ ID NO: 1881 - DNA, 18 bp, Artificial Sequence
  Synthetic DNA
gttgttagggcaaggggc

SEQ ID NO: 1882 - DNA, 23 bp, Artificial Sequence
  Synthetic DNA
cagtggagaccagttgggtagtg

SEQ ID NO: 1883 - DNA, 28 bp, Artificial Sequence
  Synthetic DNA
cacacatgcagagcttgtagcgtaccca

SEQ ID NO: 1884 - DNA, 20 bp, Artificial Sequence
  Synthetic DNA
ccttgaagagcgtcccatca

SEQ ID NO: 1885 - DNA, 20 bp, Artificial Sequence
  Synthetic DNA
ccaacaccttcttggcttct

SEQ ID NO: 1886 - DNA, 24 bp, Artificial Sequence
  Synthetic DNA
cctgtgttcttgctgagcaccctc

SEQ ID NO: 1887 - DNA, 20 bp, Artificial Sequence
  Synthetic DNA
ctgttatcccaacccaaacc

SEQ ID NO: 1888 - DNA, 21 bp, Artificial Sequence
  Synthetic DNA
gtccaaggcacatatccactg

SEQ ID NO: 1889 - DNA, 24 bp, Artificial Sequence
  Synthetic DNA
caccgagttctctgctttcaccga

SEQ ID NO: 1890 - DNA, 18 bp, Artificial Sequence
  Synthetic DNA
gaagcagcctcccgattt

SEQ ID NO: 1891 - DNA, 20 bp, Artificial Sequence
  Synthetic DNA
aacggactccctcaatttgt

SEQ ID NO: 1892 - DNA, 24 bp, Artificial Sequence
  Synthetic DNA
tgtccatggtcatgcaaatcttgc

SEQ ID NO: 1893 - DNA, 20 bp, Artificial Sequence
  Synthetic DNA
gaaattgcagggtccaagat

SEQ ID NO: 1894 - DNA, 21 bp, Artificial Sequence
  Synthetic DNA
ttggcattggaactacattca

SEQ ID NO: 1895 - DNA, 24 bp, Artificial Sequence
  Synthetic DNA
tccgcggtatcctcggattagttc

SEQ ID NO: 1896 - DNA, 19 bp, Artificial Sequence
  Synthetic DNA
ggtatggagaagggggtcc

SEQ ID NO: 1897 - DNA, 20 bp, Artificial Sequence
  Synthetic DNA
aaccacagttggaggaggac

SEQ ID NO: 1898 - DNA, 23 bp, Artificial Sequence
  Synthetic DNA
cagagacagtttccctccccgct

SEQ ID NO: 1899 - DNA, 20 bp, Artificial Sequence
  Synthetic DNA
cgaaggaagggtgttggtat

SEQ ID NO: 1900 - DNA, 18 bp, Artificial Sequence
  Synthetic DNA
tccagcccaaatcctcct

SEQ ID NO: 1901 - DNA, 24 bp, Artificial Sequence
  Synthetic DNA
tggcacatcctaccccagatgcta

SEQ ID NO: 1902 - DNA, 20 bp, Artificial Sequence
  Synthetic DNA
ggtgtcctggagtccttgaa

SEQ ID NO: 1903 - DNA, 20 bp, Artificial Sequence
  Synthetic DNA
gatggtaggaagggatgtgc

SEQ ID NO: 1904 - DNA, 23 bp, Artificial Sequence
  Synthetic DNA
cgcctctccacgcactcagctat

SEQ ID NO: 1905 - DNA, 21 bp, Artificial Sequence
  Synthetic DNA
cacaaggagctgtgaatgagg

SEQ ID NO: 1906 - DNA, 20 bp, Artificial Sequence
  Synthetic DNA
ccagagtcatgctcatccag

SEQ ID NO: 1907 - DNA, 23 bp, Artificial Sequence
  Synthetic DNA
ctgtccctgcactggtgcaactg

SEQ ID NO: 1908 - DNA, 20 bp, Artificial Sequence
  Synthetic DNA
ccaccttcagcctctgaaat

SEQ ID NO: 1909 - DNA, 20 bp, Artificial Sequence
  Synthetic DNA
agctggggtgtctgtttcat

SEQ ID NO: 1910 - DNA, 23 bp, Artificial Sequence
  Synthetic DNA
cctgacttcaggtcaagggatgg

SEQ ID NO: 1911 - DNA, 20 bp, Artificial Sequence
  Synthetic DNA
acagcaaggcgagcataaat

SEQ ID NO: 1912 - DNA, 22 bp, Artificial Sequence
  Synthetic DNA
ccattgcctttgctttgttcat

SEQ ID NO: 1913 - DNA, 27 bp, Artificial Sequence
  Synthetic DNA
tcccatggtttttattctgccctgctg

SEQ ID NO: 1914 - DNA, 21 bp, Artificial Sequence
  Synthetic DNA
ttccggatttcctttctttgc

SEQ ID NO: 1915 - DNA, 23 bp, Artificial Sequence
  Synthetic DNA
agttgcagaatctaagcctggaa

SEQ ID NO: 1916 - DNA, 20 bp, Artificial Sequence
  Synthetic DNA
cctgcggctttcggatccca

SEQ ID NO: 1917 - DNA, 25 bp, Artificial Sequence
  Synthetic DNA
tgagttttttgcgagagtattgaca

SEQ ID NO: 1918 - DNA, 20 bp, Artificial Sequence
  Synthetic DNA
tctgccagtgctgaattctt

SEQ ID NO: 1919 - DNA, 24 bp, Artificial Sequence
  Synthetic DNA
tgctgacattgccctggctcctat

SEQ ID NO: 1920 - DNA, 20 bp, Artificial Sequence
  Synthetic DNA
ttcgaaccttagcagcttcc

SEQ ID NO: 1921 - DNA, 18 bp, Artificial Sequence
  Synthetic DNA
gcctgagtctcctgtgcc

SEQ ID NO: 1922 - DNA, 24 bp, Artificial Sequence
  Synthetic DNA
acatcccaggcttcaccctgaatg

SEQ ID NO: 1923 - DNA, 19 bp, Artificial Sequence
  Synthetic DNA
agtctccaccctcaggcat

SEQ ID NO: 1924 - DNA, 19 bp, Artificial Sequence
  Synthetic DNA
ccgttcgaagagtcgtgag

SEQ ID NO: 1925 - DNA, 24 bp, Artificial Sequence
  Synthetic DNA
tctccgaatcttaacccgtcaccc

SEQ ID NO: 1926 - DNA, 20 bp, Artificial Sequence
  Synthetic DNA
agtccagccactagcacctc

SEQ ID NO: 1927 - DNA, 20 bp, Artificial Sequence
  Synthetic DNA
cctgctttcaaccacattga

SEQ ID NO: 1928 - DNA, 24 bp, Artificial Sequence
  Synthetic DNA
tcccattgctcttgccactctgat

SEQ ID NO: 1929 - DNA, 20 bp, Artificial Sequence
  Synthetic DNA
agagcagcttcacaaacgag

SEQ ID NO: 1930 - DNA, 18 bp, Artificial Sequence
  Synthetic DNA
gcgcagaggccagttaaa

SEQ ID NO: 1931 - DNA, 24 bp, Artificial Sequence
  Synthetic DNA
agatcacctcctcgaacccactcc

SEQ ID NO: 1932 - DNA, 18 bp, Artificial Sequence
  Synthetic DNA
agctgagctgtgggttgc

SEQ ID NO: 1933 - DNA, 19 bp, Artificial Sequence
  Synthetic DNA
atggccaatgtttgatgct

SEQ ID NO: 1934 - DNA, 25 bp, Artificial Sequence
  Synthetic DNA
tggccatccatctcacagaaattgg

SEQ ID NO: 1935 - DNA, 20 bp, Artificial Sequence
  Synthetic DNA
acacttcaagtcacgcttgc

SEQ ID NO: 1936 - DNA, 19 bp, Artificial Sequence
  Synthetic DNA
agggactgtcctggcacat

SEQ ID NO: 1937 - DNA, 24 bp, Artificial Sequence
  Synthetic DNA
agcaaaagacccaggacatctgca

SEQ ID NO: 1938 - DNA, 19 bp, Artificial Sequence
  Synthetic DNA
caacaaatttgccgcagtc

SEQ ID NO: 1939 - DNA, 20 bp, Artificial Sequence
  Synthetic DNA
cccaatcggaagcctaacta

SEQ ID NO: 1940 - DNA, 25 bp, Artificial Sequence
  Synthetic DNA
tctggattagagtcctgcagctcgc

SEQ ID NO: 1941 - DNA, 20 bp, Artificial Sequence
  Synthetic DNA
gtagggctgctggaaggtaa

SEQ ID NO: 1942 - DNA, 19 bp, Artificial Sequence
  Synthetic DNA
ggctggccaaacataagca

SEQ ID NO: 1943 - DNA, 29 bp, Artificial Sequence
  Synthetic DNA
ctgcactgcgatgcccagtctagaaaatc

SEQ ID NO: 1944 - DNA, 26 bp, Artificial Sequence
  Synthetic DNA
tccttgtcacagtatttacagctgaa

SEQ ID NO: 1945 - DNA, 20 bp, Artificial Sequence
  Synthetic DNA
ggctggtcggcagagagtag

SEQ ID NO: 1946 - DNA, 29 bp, Artificial Sequence
  Synthetic DNA
aaactcatgtaaaccacggccgaatgttg

SEQ ID NO: 1947 - DNA, 21 bp, Artificial Sequence
  Synthetic DNA
tgaggaaaggtttgggattga

SEQ ID NO: 1948 - DNA, 20 bp, Artificial Sequence
  Synthetic DNA
tgaagagaggcatgttggag

SEQ ID NO: 1949 - DNA, 24 bp, Artificial Sequence
  Synthetic DNA
tttgtcagcagtcacattgcccaa

SEQ ID NO: 1950 - DNA, 20 bp, Artificial Sequence
  Synthetic DNA
aatagacacatcggccacac

SEQ ID NO: 1951 - DNA, 21 bp, Artificial Sequence
  Synthetic DNA
gcttgtccaaatcaggatcca

SEQ ID NO: 1952 - DNA, 27 bp, Artificial Sequence
  Synthetic DNA
aacaacaggccttattccactgctggg

SEQ ID NO: 1953 - DNA, 19 bp, Artificial Sequence
  Synthetic DNA
agcgtgctcccacacatca

SEQ ID NO: 1954 - DNA, 20 bp, Artificial Sequence
  Synthetic DNA
tctgcaccaaattctccaag

SEQ ID NO: 1955 - DNA, 23 bp, Artificial Sequence
  Synthetic DNA
aacaccgttaacacctccgcctg

SEQ ID NO: 1956 - DNA, 20 bp, Artificial Sequence
  Synthetic DNA
gtggtactggaagcaccaga

SEQ ID NO: 1957 - DNA, 18 bp, Artificial Sequence
  Synthetic DNA
tcgtgtgcaagcctgaga

SEQ ID NO: 1958 - DNA, 23 bp, Artificial Sequence
  Synthetic DNA
ctcccctaccaggggcatgactc

SEQ ID NO: 1959 - DNA, 19 bp, Artificial Sequence
  Synthetic DNA
ctgtcggggagattcacac

SEQ ID NO: 1960 - DNA, 23 bp, Artificial Sequence
  Synthetic DNA
tcttccctgtacactggcagttc

SEQ ID NO: 1961 - DNA, 22 bp, Artificial Sequence
  Synthetic DNA
tggaccagcaccccattgacgg

SEQ ID NO: 1962 - DNA, 20 bp, Artificial Sequence
  Synthetic DNA
agctcggtgtgggagaggta

SEQ ID NO: 1963 - DNA, 19 bp, Artificial Sequence
  Synthetic DNA
aggaatgcagcggattcct

SEQ ID NO: 1964 - DNA, 23 bp, Artificial Sequence
  Synthetic DNA
cccaagtgctcccagaaggcagg

SEQ ID NO: 1965 - DNA, 20 bp, Artificial Sequence
  Synthetic DNA
tcgctggagtggtcttcaga

SEQ ID NO: 1966 - DNA, 21 bp, Artificial Sequence
  Synthetic DNA
cagaccagtccctgtcatagg

SEQ ID NO: 1967 - DNA, 23 bp, Artificial Sequence
  Synthetic DNA
ctgggtccggattgccctttcag

SEQ ID NO: 1968 - DNA, 24 bp, Artificial Sequence
  Synthetic DNA
ccttcaagtcatccacaatcagtt

SEQ ID NO: 1969 - DNA, 20 bp, Artificial Sequence
  Synthetic DNA
tgtggcaagtgcaaatgtaa

SEQ ID NO: 1970 - DNA, 24 bp, Artificial Sequence
  Synthetic DNA
cagaggccttgggtaggtgcactc

SEQ ID NO: 1971 - DNA, 20 bp, Artificial Sequence
  Synthetic DNA
gtcgcagatccagtctgatg

SEQ ID NO: 1972 - DNA, 20 bp, Artificial Sequence
  Synthetic DNA
agatggaagaagccaacctg

SEQ ID NO: 1973 - DNA, 22 bp, Artificial Sequence
  Synthetic DNA
ctggatcagctcctgggccttc

SEQ ID NO: 1974 - DNA, 19 bp, Artificial Sequence
  Synthetic DNA
ctgtggctgaggatctggt

SEQ ID NO: 1975 - DNA, 20 bp, Artificial Sequence
  Synthetic DNA
tgactgcacatggaacattg

SEQ ID NO: 1976 - DNA, 22 bp, Artificial Sequence
  Synthetic DNA
aggtgcccaacaaccagcatgt

SEQ ID NO: 1977 - DNA, 20 bp, Artificial Sequence
  Synthetic DNA
aagaatttgaagcgcacctt

SEQ ID NO: 1978 - DNA, 20 bp, Artificial Sequence
  Synthetic DNA
gggctcagctttcagaagtg

SEQ ID NO: 1979 - DNA, 25 bp, Artificial Sequence
  Synthetic DNA
tggcagttttcttctgtcaccaaaa

SEQ ID NO: 1980 - DNA, 20 bp, Artificial Sequence
  Synthetic DNA
acatgttcagctggtccaca

SEQ ID NO: 1981 - DNA, 20 bp, Artificial Sequence
  Synthetic DNA
tcacatgccactttggtgtt

SEQ ID NO: 1982 - DNA, 22 bp, Artificial Sequence
  Synthetic DNA
tcctgggagagattgaccagca

SEQ ID NO: 1983 - DNA, 20 bp, Artificial Sequence
  Synthetic DNA
cttgcaggaagcggctatac

SEQ ID NO: 1984 - DNA, 21 bp, Artificial Sequence
  Synthetic DNA
gaggcgctcaacatgaaattc

SEQ ID NO: 1985 - DNA, 22 bp, Artificial Sequence
  Synthetic DNA
cggttgctctgcacttcggcct

SEQ ID NO: 1986 - DNA, 20 bp, Artificial Sequence
  Synthetic DNA
gccaggaacacgaggttctc

SEQ ID NO: 1987 - DNA, 20 bp, Artificial Sequence
  Synthetic DNA
ccagtggtggtgatcgttca

SEQ ID NO: 1988 - DNA, 23 bp, Artificial Sequence
  Synthetic DNA
cagccaggacaacaatgcgacgg

SEQ ID NO: 1989 - DNA, 21 bp, Artificial Sequence
  Synthetic DNA
gcaaaagcattgtcccagaga

SEQ ID NO: 1990 - DNA, 19 bp, Artificial Sequence
  Synthetic DNA
ctccgaggtgaggaggact

SEQ ID NO: 1991 - DNA, 24 bp, Artificial Sequence
  Synthetic DNA
cacatcaaacgcacatcccatgag

SEQ ID NO: 1992 - DNA, 20 bp, Artificial Sequence
  Synthetic DNA
acctctccctggttatgcac

SEQ ID NO: 1993 - DNA, 18 bp, Artificial Sequence
  Synthetic DNA
ggactcggagacgctgtg

SEQ ID NO: 1994 - DNA, 24 bp, Artificial Sequence
  Synthetic DNA
ttcttgaggatcttgacggccctc

SEQ ID NO: 1995 - DNA, 20 bp, Artificial Sequence
  Synthetic DNA
gggatccttcgcaacttctt

SEQ ID NO: 1996 - DNA, 20 bp, Artificial Sequence
  Synthetic DNA
catcttccaggaggaccact

SEQ ID NO: 1997 - DNA, 24 bp, Artificial Sequence
  Synthetic DNA
ctctgtggcaccctggactacctg

SEQ ID NO: 1998 - DNA, 20 bp, Artificial Sequence
  Synthetic DNA
tccgaccttcaatcatttca

SEQ ID NO: 1999 - DNA, 20 bp, Artificial Sequence
  Synthetic DNA
aatacccaacgcacaaatga

SEQ ID NO: 2000 - DNA, 23 bp, Artificial Sequence
  Synthetic DNA
cacgttctctgccccgtttcttg

SEQ ID NO: 2001 - DNA, 20 bp, Artificial Sequence
  Synthetic DNA
ggagacaatgcaaaccacac

SEQ ID NO: 2002 - DNA, 20 bp, Artificial Sequence
  Synthetic DNA
cctggaggctgcaacatacc

SEQ ID NO: 2003 - DNA, 25 bp, Artificial Sequence
  Synthetic DNA
atcctcctgaagcccttttcgcagc

SEQ ID NO: 2004 - DNA, 23 bp, Artificial Sequence
  Synthetic DNA
tacaatggctttggaggatagca

SEQ ID NO: 2005 - DNA, 25 bp, Artificial Sequence
  Synthetic DNA
gaagatccctttcctcctactgttc

SEQ ID NO: 2006 - DNA, 22 bp, Artificial Sequence
  Synthetic DNA
cttcgtggctctcggcttccca

SEQ ID NO: 2007 - DNA, 20 bp, Artificial Sequence
  Synthetic DNA
ggatgatgttcggccttgat

SEQ ID NO: 2008 - DNA, 20 bp, Artificial Sequence
  Synthetic DNA
tgttttgattcccgggctta

SEQ ID NO: 2009 - DNA, 28 bp, Artificial Sequence
  Synthetic DNA
tgccttcttcctccctcacttctcacct

SEQ ID NO: 2010 - DNA, 24 bp, Artificial Sequence
  Synthetic DNA
caaagctgtcagctctagcaaaag

SEQ ID NO: 2011 - DNA, 20 bp, Artificial Sequence
  Synthetic DNA
gatggagcaggtggctcagt

SEQ ID NO: 2012 - DNA, 24 bp, Artificial Sequence
  Synthetic DNA
cccagagtcctcagccgccttcag

SEQ ID NO: 2013 - DNA, 25 bp, Artificial Sequence
  Synthetic DNA
agtctggaacatgtcagtcttgatg

SEQ ID NO: 2014 - DNA, 19 bp, Artificial Sequence
  Synthetic DNA
gcccgaaacgccgaatata

SEQ ID NO: 2015 - DNA, 21 bp, Artificial Sequence
  Synthetic DNA
taccgcagcaaaccgcttggg

SEQ ID NO: 2016 - DNA, 23 bp, Artificial Sequence
  Synthetic DNA
cgtggctctcttatcctcatgat

SEQ ID NO: 2017 - DNA, 18 bp, Artificial Sequence
  Synthetic DNA
gaggtcctgagcactgcc

SEQ ID NO: 2018 - DNA, 24 bp, Artificial Sequence
  Synthetic DNA
ctgggttcacaggctcctttgtcc

SEQ ID NO: 2019 - DNA, 19 bp, Artificial Sequence
  Synthetic DNA
gatgtgggaccatgcttgt

SEQ ID NO: 2020 - DNA, 20 bp, Artificial Sequence
  Synthetic DNA
gcagctgcagtcaacagttc

SEQ ID NO: 2021 - DNA, 24 bp, Artificial Sequence
  Synthetic DNA
aagtcatggcccaaatccagtgtg

SEQ ID NO: 2022 - DNA, 18 bp, Artificial Sequence
  Synthetic DNA
ctgtgaatggggaggggt

SEQ ID NO: 2023 - DNA, 19 bp, Artificial Sequence
  Synthetic DNA
ccgggacactttccagaag

SEQ ID NO: 2024 - DNA, 24 bp, Artificial Sequence
  Synthetic DNA
tctcacttcggcgaaatagtcccg

SEQ ID NO: 2025 - DNA, 18 bp, Artificial Sequence
  Synthetic DNA
agaacgcgctgtcctgag

SEQ ID NO: 2026 - DNA, 20 bp, Artificial Sequence
  Synthetic DNA
ccaatcacgacaggaggatt

SEQ ID NO: 2027 - DNA, 24 bp, Artificial Sequence
  Synthetic DNA
agacacccctaccccacagctctg

SEQ ID NO: 2028 - DNA, 19 bp, Artificial Sequence
  Synthetic DNA
tggacacggaagcattgac

SEQ ID NO: 2029 - DNA, 24 bp, Artificial Sequence
  Synthetic DNA
ctgactgctctgcttaaaggtgaa

SEQ ID NO: 2030 - DNA, 29 bp, Artificial Sequence
  Synthetic DNA
tagcaggaacaacaacaaaagccaaccaa

SEQ ID NO: 2031 - DNA, 23 bp, Artificial Sequence
  Synthetic DNA
atgtcttgcactggctaccttgt

SEQ ID NO: 2032 - DNA, 28 bp, Artificial Sequence
  Synthetic DNA
acttcggtgctacttaacaacttacatc

SEQ ID NO: 2033 - DNA, 25 bp, Artificial Sequence
  Synthetic DNA
agctcggaccacgtactgctccctg

SEQ ID NO: 2034 - DNA, 19 bp, Artificial Sequence
  Synthetic DNA
cctgggccttggtgttgac

SEQ ID NO: 2035 - DNA, 19 bp, Artificial Sequence
  Synthetic DNA
aagaggaacggagcgagtc

SEQ ID NO: 2036 - DNA, 23 bp, Artificial Sequence
  Synthetic DNA
cacgtcccacagctcagggaatc

SEQ ID NO: 2037 - DNA, 19 bp, Artificial Sequence
  Synthetic DNA
atgtgtgagccgagtcctg

SEQ ID NO: 2038 - DNA, 23 bp, Artificial Sequence
  Synthetic DNA
gacatggagaacaagctgtttgc

SEQ ID NO: 2039 - DNA, 21 bp, Artificial Sequence
  Synthetic DNA
accaaacgcaggagcagcccg

SEQ ID NO: 2040 - DNA, 24 bp, Artificial Sequence
  Synthetic DNA
gaggtgtcaccaacaagaaatcat

SEQ ID NO: 2041 - DNA, 25 bp, Artificial Sequence
  Synthetic DNA
aggcactgttcatctcagtttttct

SEQ ID NO: 2042 - DNA, 24 bp, Artificial Sequence
  Synthetic DNA
cagaaagcttgccgggagcaaagg

SEQ ID NO: 2043 - DNA, 25 bp, Artificial Sequence
  Synthetic DNA
catcaggctccagatatgaactttc

SEQ ID NO: 2044 - DNA, 20 bp, Artificial Sequence
  Synthetic DNA
ggtgtgccacagaccttcct

SEQ ID NO: 2045 - DNA, 27 bp, Artificial Sequence
  Synthetic DNA
ttggcctgtaatcacctgtgcagcctt

SEQ ID NO: 2046 - DNA, 24 bp, Artificial Sequence
  Synthetic DNA
acggagttcttgacagagttttga

SEQ ID NO: 2047 - DNA, 20 bp, Artificial Sequence
  Synthetic DNA
accagtcccccagaagacta

SEQ ID NO: 2048 - DNA, 21 bp, Artificial Sequence
  Synthetic DNA
tcctgagcccgaggaagtccc

SEQ ID NO: 2049 - DNA, 20 bp, Artificial Sequence
  Synthetic DNA
cctggtgctgttgtagatgg

SEQ ID NO: 2050 - DNA, 22 bp, Artificial Sequence
  Synthetic DNA
ggatcgagctcttccagatcct

SEQ ID NO: 2051 - DNA, 21 bp, Artificial Sequence
  Synthetic DNA
cggccagatgagcacattgcc

SEQ ID NO: 2052 - DNA, 20 bp, Artificial Sequence
  Synthetic DNA
gccaccgatatagcgctgtt

SEQ ID NO: 2053 - DNA, 19 bp, Artificial Sequence
  Synthetic DNA
gctacgagtgctgtcctgg

SEQ ID NO: 2054 - DNA, 24 bp, Artificial Sequence
  Synthetic DNA
ccttctccccagggaccttttcat

SEQ ID NO: 2055 - DNA, 19 bp, Artificial Sequence
  Synthetic DNA
agtggtagggctgctggac

SEQ ID NO: 2056 - DNA, 18 bp, Artificial Sequence
  Synthetic DNA
gtcatcacctggccttgg

SEQ ID NO: 2057 - DNA, 24 bp, Artificial Sequence
  Synthetic DNA
agcaatgacagctgccagttccac

SEQ ID NO: 2058 - DNA, 19 bp, Artificial Sequence
  Synthetic DNA
gcagacgaagcacactggt

SEQ ID NO: 2059 - DNA, 20 bp, Artificial Sequence
  Synthetic DNA
aacaccaatgggttccatct

SEQ ID NO: 2060 - DNA, 24 bp, Artificial Sequence
  Synthetic DNA
ttctgggctcctgattgctcaagc

SEQ ID NO: 2061 - DNA, 20 bp, Artificial Sequence
  Synthetic DNA
cctcttcatcaggccaaact

SEQ ID NO: 2062 - DNA, 22 bp, Artificial Sequence
  Synthetic DNA
catccgcaaagtgactgaagag

SEQ ID NO: 2063 - DNA, 22 bp, Artificial Sequence
  Synthetic DNA
ccaatgagctgaggcggcctcc

SEQ ID NO: 2064 - DNA, 27 bp, Artificial Sequence
  Synthetic DNA
gtactgaactccgttgtgatagcatag

SEQ ID NO: 2065 - DNA, 20 bp, Artificial Sequence
  Synthetic DNA
ggacaagaccctctcaggct

SEQ ID NO: 2066 - DNA, 24 bp, Artificial Sequence
  Synthetic DNA
caagctcccaagagcttccagagc

SEQ ID NO: 2067 - DNA, 18 bp, Artificial Sequence
  Synthetic DNA
ttggaggctgtgggtcag

SEQ ID NO: 2068 - DNA, 19 bp, Artificial Sequence
  Synthetic DNA
tccctgcggtcccagatag

SEQ ID NO: 2069 - DNA, 25 bp, Artificial Sequence
  Synthetic DNA
atcctgcccggagtggaactgaagc

SEQ ID NO: 2070 - DNA, 20 bp, Artificial Sequence
  Synthetic DNA
gtgggaacagggtggacact

SEQ ID NO: 2071 - DNA, 22 bp, Artificial Sequence
  Synthetic DNA
tcaccctctgtgacttcatcgt

SEQ ID NO: 2072 - DNA, 22 bp, Artificial Sequence
  Synthetic DNA
ccctgggacaccctgagcacca

SEQ ID NO: 2073 - DNA, 22 bp, Artificial Sequence
  Synthetic DNA
tgtggttcaggctcttcttctg

SEQ ID NO: 2074 - DNA, 20 bp, Artificial Sequence
  Synthetic DNA
ctacctgccttgctttgtga

SEQ ID NO: 2075 - DNA, 24 bp, Artificial Sequence
  Synthetic DNA
ccaagaacgagtgtctctggaccg

SEQ ID NO: 2076 - DNA, 20 bp, Artificial Sequence
  Synthetic DNA
accgaaattggagagcatgt

SEQ ID NO: 2077 - DNA, 20 bp, Artificial Sequence
  Synthetic DNA
actttgctgggacaaaggtc

SEQ ID NO: 2078 - DNA, 21 bp, Artificial Sequence
  Synthetic DNA
ctcgggcctgcccacttcttc

SEQ ID NO: 2079 - DNA, 20 bp, Artificial Sequence
  Synthetic DNA
cacatggactcctcagcatc

SEQ ID NO: 2080 - DNA, 20 bp, Artificial Sequence
  Synthetic DNA
gccgggaagaccgtaattgt

SEQ ID NO: 2081 - DNA, 26 bp, Artificial Sequence
  Synthetic DNA
caaatggcttcctctggaaggtccca

SEQ ID NO: 2082 - DNA, 18 bp, Artificial Sequence
  Synthetic DNA
cagcggcaccaggttcag

SEQ ID NO: 2083 - DNA, 22 bp, Artificial Sequence
  Synthetic DNA
aagcagaagggagagcgtaaga

SEQ ID NO: 2084 - DNA, 26 bp, Artificial Sequence
  Synthetic DNA
cttccaggcacacaagaattgtgggc

SEQ ID NO: 2085 - DNA, 21 bp, Artificial Sequence
  Synthetic DNA
ccttggcctcaatctcactca

SEQ ID NO: 2086 - DNA, 18 bp, Artificial Sequence
  Synthetic DNA
cagaaggatgcctgtggc

SEQ ID NO: 2087 - DNA, 24 bp, Artificial Sequence
  Synthetic DNA
attccgttgcctgacactgtgctc

SEQ ID NO: 2088 - DNA, 18 bp, Artificial Sequence
  Synthetic DNA
gtagacctgcggctctgg

SEQ ID NO: 2089 - DNA, 20 bp, Artificial Sequence
  Synthetic DNA
gaaatcgccagcttcgataa

SEQ ID NO: 2090 - DNA, 24 bp, Artificial Sequence
  Synthetic DNA
cgtctccgttttcttcagcttggc

SEQ ID NO: 2091 - DNA, 19 bp, Artificial Sequence
  Synthetic DNA
gtcggcagggtgttctttt

SEQ ID NO: 2092 - DNA, 26 bp, Artificial Sequence
  Synthetic DNA
cacatcaaagaactactgacaacgaa

SEQ ID NO: 2093 - DNA, 18 bp, Artificial Sequence
  Synthetic DNA
ccgcgcctgcctttccca

SEQ ID NO: 2094 - DNA, 23 bp, Artificial Sequence
  Synthetic DNA
cctgccagccagatagatagaca

SEQ ID NO: 2095 - DNA, 18 bp, Artificial Sequence
  Synthetic DNA
agctcggaacctcaccgt

SEQ ID NO: 2096 - DNA, 23 bp, Artificial Sequence
  Synthetic DNA
cagccttcgggctgtggacatac

SEQ ID NO: 2097 - DNA, 18 bp, Artificial Sequence
  Synthetic DNA
gtagcagccttgaggccc

SEQ ID NO: 2098 - DNA, 20 bp, Artificial Sequence
  Synthetic DNA
ggagaagggtgaccgactca

SEQ ID NO: 2099 - DNA, 24 bp, Artificial Sequence
  Synthetic DNA
cgctgagatcaatcggcccgacta

SEQ ID NO: 2100 - DNA, 18 bp, Artificial Sequence
  Synthetic DNA
tgcccagactcggcaaag

SEQ ID NO: 2101 - DNA, 21 bp, Artificial Sequence
  Synthetic DNA
tctcacctcgctatggttcgt

SEQ ID NO: 2102 - DNA, 23 bp, Artificial Sequence
  Synthetic DNA
tgcctctgcagtgcgtcctctgg

SEQ ID NO: 2103 - DNA, 19 bp, Artificial Sequence
  Synthetic DNA
gatggacagcggtcagcaa

SEQ ID NO: 2104 - DNA, 19 bp, Artificial Sequence
  Synthetic DNA
cctcagcaccagggtacca

SEQ ID NO: 2105 - DNA, 24 bp, Artificial Sequence
  Synthetic DNA
tgacggcacgctcacactcctcag

SEQ ID NO: 2106 - DNA, 21 bp, Artificial Sequence
  Synthetic DNA
tgtcctggaaagccacaaagt

SEQ ID NO: 2107 - DNA, 22 bp, Artificial Sequence
  Synthetic DNA
cttcatcttccctctacccaga

SEQ ID NO: 2108 - DNA, 24 bp, Artificial Sequence
  Synthetic DNA
caggggttggaccctttccatctt

SEQ ID NO: 2109 - DNA, 20 bp, Artificial Sequence
  Synthetic DNA
gctgcatttcccacattctc

SEQ ID NO: 2110 - DNA, 20 bp, Artificial Sequence
  Synthetic DNA
aatccaagggggagagtgat

SEQ ID NO: 2111 - DNA, 26 bp, Artificial Sequence
  Synthetic DNA
catatggactttgactcagctgtggc

SEQ ID NO: 2112 - DNA, 20 bp, Artificial Sequence
  Synthetic DNA
gtacagattttgcccgagga

SEQ ID NO: 2113 - DNA, 21 bp, Artificial Sequence
  Synthetic DNA
tgtggacatcttcccctcaga

SEQ ID NO: 2114 - DNA, 24 bp, Artificial Sequence
  Synthetic DNA
ttccctactgagccaccttctctg

SEQ ID NO: 2115 - DNA, 18 bp, Artificial Sequence
  Synthetic DNA
ctagcccgaccggttcgt

SEQ ID NO: 2116 - DNA, 24 bp, Artificial Sequence
  Synthetic DNA
ctatatgcagccagagatgtgaca

SEQ ID NO: 2117 - DNA, 23 bp, Artificial Sequence
  Synthetic DNA
acagcctgccactcatcacagcc

SEQ ID NO: 2118 - DNA, 24 bp, Artificial Sequence
  Synthetic DNA
ccacgagtttcttactgagaatgg

SEQ ID NO: 2119 - DNA, 20 bp, Artificial Sequence
  Synthetic DNA
tgctgttgctgagtctgttg

SEQ ID NO: 2120 - DNA, 24 bp, Artificial Sequence
  Synthetic DNA
ccagtccccagaagaccatgtctg

SEQ ID NO: 2121 - DNA, 20 bp, Artificial Sequence
  Synthetic DNA
cttgcctggcttcacagata

SEQ ID NO: 2122 - DNA, 19 bp, Artificial Sequence
  Synthetic DNA
gggccaaatattcagaagc

SEQ ID NO: 2123 - DNA, 20 bp, Artificial Sequence
  Synthetic DNA
ccaccatagcggccatggag

SEQ ID NO: 2124 - DNA, 20 bp, Artificial Sequence
  Synthetic DNA
ggatgggtatgatgggacag

SEQ ID NO: 2125 - DNA, 20 bp, Artificial Sequence
  Synthetic DNA
gcggacttaatgcagagaca

SEQ ID NO: 2126 - DNA, 24 bp, Artificial Sequence
  Synthetic DNA
cagtatgacccacctccaggagcc

SEQ ID NO: 2127 - DNA, 20 bp, Artificial Sequence
  Synthetic DNA
tcaagtcccaaaatgttgct

SEQ ID NO: 2128 - DNA, 21 bp, Artificial Sequence
  Synthetic DNA
gacgctggtctggtgaagatg

SEQ ID NO: 2129 - DNA, 23 bp, Artificial Sequence
  Synthetic DNA
ccaggaaaccacgagcctccagc

SEQ ID NO: 2130 - DNA, 20 bp, Artificial Sequence
  Synthetic DNA
tgggtggttgttggacaatg

SEQ ID NO: 2131 - DNA, 22 bp, Artificial Sequence
  Synthetic DNA
cttcacagtgctcctgcagtct

SEQ ID NO: 2132 - DNA, 26 bp, Artificial Sequence
  Synthetic DNA
aagtacacgtaagttacagccacaca

SEQ ID NO: 2133 - DNA, 21 bp, Artificial Sequence
  Synthetic DNA
catctgcttcagctcgttggt

SEQ ID NO: 2134 - DNA, 18 bp, Artificial Sequence
  Synthetic DNA
gcctcggtgtgcctttca

SEQ ID NO: 2135 - DNA, 22 bp, Artificial Sequence
  Synthetic DNA
catcgccagctacgccctgctc

SEQ ID NO: 2136 - DNA, 19 bp, Artificial Sequence
  Synthetic DNA
cgtgatgtgcgcaatcatg

SEQ ID NO: 2137 - DNA, 19 bp, Artificial Sequence
  Synthetic DNA
ggagccggatgcagtagga

SEQ ID NO: 2138 - DNA, 23 bp, Artificial Sequence
  Synthetic DNA
accacggatatggcccgagtcca

SEQ ID NO: 2139 - DNA, 22 bp, Artificial Sequence
  Synthetic DNA
aagtccatgaaaggcatgttga

SEQ ID NO: 2140 - DNA, 19 bp, Artificial Sequence
  Synthetic DNA
tgtcaccccgactcaacgt

SEQ ID NO: 2141 - DNA, 21 bp, Artificial Sequence
  Synthetic DNA
agacgcaccgcccggactcac

SEQ ID NO: 2142 - DNA, 22 bp, Artificial Sequence
  Synthetic DNA
acgtggactgagatgcattcac

SEQ ID NO: 2143 - DNA, 20 bp, Artificial Sequence
  Synthetic DNA
cgaggacgaggcttaaaaac

SEQ ID NO: 2144 - DNA, 29 bp, Artificial Sequence
  Synthetic DNA
tctcagatcaatcgtgcatccttagtgaa

SEQ ID NO: 2145 - DNA, 20 bp, Artificial Sequence
  Synthetic DNA
accatgcttgaggacaacag

SEQ ID NO: 2146 - DNA, 19 bp, Artificial Sequence
  Synthetic DNA
gtatcaccatcaatgcggc

SEQ ID NO: 2147 - DNA, 24 bp, Artificial Sequence
  Synthetic DNA
catgtggagtatagcactgccgcc

SEQ ID NO: 2148 - DNA, 20 bp, Artificial Sequence
  Synthetic DNA
cagtctgtgtgggcgtagtg

SEQ ID NO: 2149 - DNA, 22 bp, Artificial Sequence
  Synthetic DNA
tgtgtatagtcctgcccctcaa

SEQ ID NO: 2150 - DNA, 26 bp, Artificial Sequence
  Synthetic DNA
ccggattatccgacatcttactgtga

SEQ ID NO: 2151 - DNA, 20 bp, Artificial Sequence
  Synthetic DNA
cccgatccattcccctttta

SEQ ID NO: 2152 - DNA, 20 bp, Artificial Sequence
  Synthetic DNA
ggaggagctaaatgcctcag

SEQ ID NO: 2153 - DNA, 24 bp, Artificial Sequence
  Synthetic DNA
actcatcaatgggcagagtgcacc

SEQ ID NO: 2154 - DNA, 20 bp, Artificial Sequence
  Synthetic DNA
ccttcaagtggatggtgttg

SEQ ID NO: 2155 - DNA, 18 bp, Artificial Sequence
  Synthetic DNA
gagtcgaccctgcacctg

SEQ ID NO: 2156 - DNA, 23 bp, Artificial Sequence
  Synthetic DNA
aattaacagccacccctcaggcg

SEQ ID NO: 2157 - DNA, 18 bp, Artificial Sequence
  Synthetic DNA
gcgaatgccatgactgaa

SEQ ID NO: 2158 - DNA, 20 bp, Artificial Sequence
  Synthetic DNA
acgcaccctgtctgactaca

SEQ ID NO: 2159 - DNA, 24 bp, Artificial Sequence
  Synthetic DNA
catccagaaagagtccaccctgca

SEQ ID NO: 2160 - DNA, 20 bp, Artificial Sequence
  Synthetic DNA
acctctaagacggagcacca

SEQ ID NO: 2161 - DNA, 20 bp, Artificial Sequence
  Synthetic DNA
tgtctggcgataaagggatt

SEQ ID NO: 2162 - DNA, 25 bp, Artificial Sequence
  Synthetic DNA
tctgccttccctgaatcagacaacc

SEQ ID NO: 2163 - DNA, 20 bp, Artificial Sequence
  Synthetic DNA
atggtccctacccatttgaa

SEQ ID NO: 2164 - DNA, 24 bp, Artificial Sequence
  Synthetic DNA
ctccataatttatggcctgcagta

SEQ ID NO: 2165 - DNA, 23 bp, Artificial Sequence
  Synthetic DNA
tcttcttggagcccaaccccgag

SEQ ID NO: 2166 - DNA, 18 bp, Artificial Sequence
  Synthetic DNA
tgcggcctccttgttcag

SEQ ID NO: 2167 - DNA, 20 bp, Artificial Sequence
  Synthetic DNA
gtgaagccaccgtcatcatg

SEQ ID NO: 2168 - DNA, 28 bp, Artificial Sequence
  Synthetic DNA
ctgaccaggaggcaaaaccttcaactga

SEQ ID NO: 2169 - DNA, 22 bp, Artificial Sequence
  Synthetic DNA
ccttccttcttatcccccaagt

SEQ ID NO: 2170 - DNA, 19 bp, Artificial Sequence
  Synthetic DNA
accatgctccagaaggagg

SEQ ID NO: 2171 - DNA, 24 bp, Artificial Sequence
  Synthetic DNA
ccccgagccttctacaaagggttc

SEQ ID NO: 2172 - DNA, 18 bp, Artificial Sequence
  Synthetic DNA
aacccaagcggagaaagg

SEQ ID NO: 2173 - DNA, 19 bp, Artificial Sequence
  Synthetic DNA
ccatgcagcctggaatttg

SEQ ID NO: 2174 - DNA, 25 bp, Artificial Sequence
  Synthetic DNA
ctacccagtgccccaacccattctc

SEQ ID NO: 2175 - DNA, 18 bp, Artificial Sequence
  Synthetic DNA
gagaggcctgggcacgta

SEQ ID NO: 2176 - DNA, 18 bp, Artificial Sequence
  Synthetic DNA
tgcggaaatgagctccac

SEQ ID NO: 2177 - DNA, 24 bp, Artificial Sequence
  Synthetic DNA
ccctggccactggggactacacta

SEQ ID NO: 2178 - DNA, 19 bp, Artificial Sequence
  Synthetic DNA
cctcagccattctaaccgc

SEQ ID NO: 2179 - DNA, 19 bp, Artificial Sequence
  Synthetic DNA
gacagctgatccaggagcc

SEQ ID NO: 2180 - DNA, 24 bp, Artificial Sequence
  Synthetic DNA
cgggtcctgcacttcaaggacagt

SEQ ID NO: 2181 - DNA, 18 bp, Artificial Sequence
  Synthetic DNA
atggataggcgcaggttg

SEQ ID NO: 2182 - DNA, 18 bp, Artificial Sequence
  Synthetic DNA
agaacggaggccgtgact

SEQ ID NO: 2183 - DNA, 24 bp, Artificial Sequence
  Synthetic DNA
cgggacgctgctcgactctaagaa

SEQ ID NO: 2184 - DNA, 18 bp, Artificial Sequence
  Synthetic DNA
catgcacagcccatctgt

SEQ ID NO: 2185 - DNA, 20 bp, Artificial Sequence
  Synthetic DNA
ctgaacacagtggagctggt

SEQ ID NO: 2186 - DNA, 22 bp, Artificial Sequence
  Synthetic DNA
acctgccgcacacagagtttgc

SEQ ID NO: 2187 - DNA, 20 bp, Artificial Sequence
  Synthetic DNA
ctggaagatctgcccttctc

SEQ ID NO: 2188 - DNA, 19 bp, Artificial Sequence
  Synthetic DNA
gtggatgtgccctgaagga

SEQ ID NO: 2189 - DNA, 28 bp, Artificial Sequence
  Synthetic DNA
aagccaggcgtctacacgagagtctcac

SEQ ID NO: 2190 - DNA, 20 bp, Artificial Sequence
  Synthetic DNA
ctgcggatccagggtaagaa

SEQ ID NO: 2191 - DNA, 18 bp, Artificial Sequence
  Synthetic DNA
acgggtcctgcctcagtt

SEQ ID NO: 2192 - DNA, 24 bp, Artificial Sequence
  Synthetic DNA
tcagctttctctgcattggctccc

SEQ ID NO: 2193 - DNA, 18 bp, Artificial Sequence
  Synthetic DNA
cggggcaatcattgtgac

SEQ ID NO: 2194 - DNA, 21 bp, Artificial Sequence
  Synthetic DNA
tggcttcaggagctgaatacc

SEQ ID NO: 2195 - DNA, 26 bp, Artificial Sequence
  Synthetic DNA
caggcacacacaggtgggacacaaat

SEQ ID NO: 2196 - DNA, 24 bp, Artificial Sequence
  Synthetic DNA
tgctgtcgtgatgagaaaatagtg

SEQ ID NO: 2197 - DNA, 23 bp, Artificial Sequence
  Synthetic DNA
gataccacaactcccatcaagct

SEQ ID NO: 2198 - DNA, 18 bp, Artificial Sequence
  Synthetic DNA
agtggcagccacggcgcc

SEQ ID NO: 2199 - DNA, 19 bp, Artificial Sequence
  Synthetic DNA
tccctgttaggcgcatcag

SEQ ID NO: 2200 - DNA, 19 bp, Artificial Sequence
  Synthetic DNA
ggctttggcagcttcagat

SEQ ID NO: 2201 - DNA, 23 bp, Artificial Sequence
  Synthetic DNA
agctccaccctggttccctgaag

SEQ ID NO: 2202 - DNA, 18 bp, Artificial Sequence
  Synthetic DNA
ctccactgccctgactgg

SEQ ID NO: 2203 - DNA, 19 bp, Artificial Sequence
  Synthetic DNA
gctgcgacatggatttcga

SEQ ID NO: 2204 - DNA, 20 bp, Artificial Sequence
  Synthetic DNA
ttgctgggccttccatccgg

SEQ ID NO: 2205 - DNA, 20 bp, Artificial Sequence
  Synthetic DNA
ccagccctcgtaacctagca

SEQ ID NO: 2206 - DNA, 18 bp, Artificial Sequence
  Synthetic DNA
acccacggacagacttgc

SEQ ID NO: 2207 - DNA, 24 bp, Artificial Sequence
  Synthetic DNA
cgcgtccaatgtgtattcctccat

SEQ ID NO: 2208 - DNA, 18 bp, Artificial Sequence
  Synthetic DNA
agctttgccaaggtcagc

SEQ ID NO: 2209 - DNA, 20 bp, Artificial Sequence
  Synthetic DNA
gccctggatttcagaaagag

SEQ ID NO: 2210 - DNA, 25 bp, Artificial Sequence
  Synthetic DNA
caagtctggatctgggaccctttcc

SEQ ID NO: 2211 - DNA, 20 bp, Artificial Sequence
  Synthetic DNA
agttacaagccagggaagga

SEQ ID NO: 2212 - DNA, 20 bp, Artificial Sequence
  Synthetic DNA
ctgctgtcttgggtgcattg

SEQ ID NO: 2213 - DNA, 25 bp, Artificial Sequence
  Synthetic DNA
ttgccttgctgctctacctccacca

SEQ ID NO: 2214 - DNA, 18 bp, Artificial Sequence
  Synthetic DNA
gcagcctgggaccacttg

SEQ ID NO: 2215 - DNA, 23 bp, Artificial Sequence
  Synthetic DNA
tgtgaatgcagaccaaagaaaga

SEQ ID NO: 2216 - DNA, 27 bp, Artificial Sequence
  Synthetic DNA
agagcaagacaagaaaatcccgtgggc

SEQ ID NO: 2217 - DNA, 20 bp, Artificial Sequence
  Synthetic DNA
gctttctccgctctgagcaa

SEQ ID NO: 2218 - DNA, 22 bp, Artificial Sequence
  Synthetic DNA
agcttcctacagcacaacaaat

SEQ ID NO: 2219 - DNA, 29 bp, Artificial Sequence
  Synthetic DNA
tgtcttgctctatctttctttggtctgca

SEQ ID NO: 2220 - DNA, 20 bp, Artificial Sequence
  Synthetic DNA
ctcggcttgtcacatttttc

SEQ ID NO: 2221 - DNA, 19 bp, Artificial Sequence
  Synthetic DNA
tgacgatggcctggagtgt

SEQ ID NO: 2222 - DNA, 21 bp, Artificial Sequence
  Synthetic DNA
ctgggcagcaccaagtccgga

SEQ ID NO: 2223 - DNA, 22 bp, Artificial Sequence
  Synthetic DNA
ggtaccggatcatgaggatctg

SEQ ID NO: 2224 - DNA, 25 bp, Artificial Sequence
  Synthetic DNA
cctcagcaagacgttatttgaaatt

SEQ ID NO: 2225 - DNA, 26 bp, Artificial Sequence
  Synthetic DNA
cctctctctcaaggccccaaaccagt

SEQ ID NO: 2226 - DNA, 24 bp, Artificial Sequence
  Synthetic DNA
aagtgtgattggcaaaactgattg

SEQ ID NO: 2227 - DNA, 21 bp, Artificial Sequence
  Synthetic DNA
tgcccttaaaggaaccaatga

SEQ ID NO: 2228 - DNA, 22 bp, Artificial Sequence
  Synthetic DNA
atttcacgcatctggcgttcca

SEQ ID NO: 2229 - DNA, 22 bp, Artificial Sequence
  Synthetic DNA
gcttcaacggcaaagttctctt

SEQ ID NO: 2230 - DNA, 19 bp, Artificial Sequence
  Synthetic DNA
tacaagctgagtgcccagg

SEQ ID NO: 2231 - DNA, 24 bp, Artificial Sequence
  Synthetic DNA
tacaaaagcctccatttcggcacc

SEQ ID NO: 2232 - DNA, 19 bp, Artificial Sequence
  Synthetic DNA
cactcgcagatgcgtcttt

SEQ ID NO: 2233 - DNA, 22 bp, Artificial Sequence
  Synthetic DNA
agaggcatccatgaacttcaca

SEQ ID NO: 2234 - DNA, 20 bp, Artificial Sequence
  Synthetic DNA
cgggctgcatcagcacacgc

SEQ ID NO: 2235 - DNA, 24 bp, Artificial Sequence
  Synthetic DNA
caaactccacagtacttgggttga

SEQ ID NO: 2236 - DNA, 20 bp, Artificial Sequence
  Synthetic DNA
acaaagctaccagggagtcg

SEQ ID NO: 2237 - DNA, 22 bp, Artificial Sequence
  Synthetic DNA
tttgtccacgccattgcctcag

SEQ ID NO: 2238 - DNA, 19 bp, Artificial Sequence
  Synthetic DNA
tgagcgtgtcactgcaaag

SEQ ID NO: 2239 - DNA, 25 bp, Artificial Sequence
  Synthetic DNA
gtatcaggaccacatgcagtacatc

SEQ ID NO: 2240 - DNA, 24 bp, Artificial Sequence
  Synthetic DNA
ttgatgcctgtcttcgcgccttct

SEQ ID NO: 2241 - DNA, 22 bp, Artificial Sequence
  Synthetic DNA
tgtcggaattgatactggcatt

SEQ ID NO: 2242 - DNA, 20 bp, Artificial Sequence
  Synthetic DNA
tgtcttcagggtcttgtcca

SEQ ID NO: 2243 - DNA, 24 bp, Artificial Sequence
  Synthetic DNA
ttccgtaagaggcctggtgctctc

SEQ ID NO: 2244 - DNA, 20 bp, Artificial Sequence
  Synthetic DNA
gtgcacgtggatgaaagagt

SEQ ID NO: 2245 - DNA, 18 bp, Artificial Sequence
  Synthetic DNA
cggtggaatctggctctg

SEQ ID NO: 2246 - DNA, 24 bp, Artificial Sequence
  Synthetic DNA
ctccctctgctcttgacctggctc

SEQ ID NO: 2247 - DNA, 20 bp, Artificial Sequence
  Synthetic DNA
ccatgaagagttgacctcgg

SEQ ID NO: 2248 - DNA, 19 bp, Artificial Sequence
  Synthetic DNA
atcgcagctggtgggtgta

SEQ ID NO: 2249 - DNA, 26 bp, Artificial Sequence
  Synthetic DNA
ctgctgtttaccttggcgaggccttt

SEQ ID NO: 2250 - DNA, 21 bp, Artificial Sequence
  Synthetic DNA
agctccctgttgcatggactt

SEQ ID NO: 2251 - DNA, 20 bp, Artificial Sequence
  Synthetic DNA
gggtagagggaaaagggttc

SEQ ID NO: 2252 - DNA, 29 bp, Artificial Sequence
  Synthetic DNA
caaaggctgaactggattcttaaccaaga

SEQ ID NO: 2253 - DNA, 21 bp, Artificial Sequence
  Synthetic DNA
tgcaccaccattgctattatt

SEQ ID NO: 2254 - DNA, 20 bp, Artificial Sequence
  Synthetic DNA
gatacatcgtctgcgaggaa

SEQ ID NO: 2255 - DNA, 24 bp, Artificial Sequence
  Synthetic DNA
ttcaaagacgtgctcctgactgcc

SEQ ID NO: 2256 - DNA, 20 bp, Artificial Sequence
  Synthetic DNA
ctttcaatgactgcctgctc

SEQ ID NO: 2257 - DNA, 18 bp, Artificial Sequence
  Synthetic DNA
ggagatgaagcccccaag

SEQ ID NO: 2258 - DNA, 24 bp, Artificial Sequence
  Synthetic DNA
agaagcaaccccagaccaaaacca

SEQ ID NO: 2259 - DNA, 18 bp, Artificial Sequence
  Synthetic DNA
gtccagctgcctgagtgg

SEQ ID NO: 2260 - DNA, 25 bp, Artificial Sequence
  Synthetic DNA
agactgtggagtttgatgttgttga

SEQ ID NO: 2261 - DNA, 23 bp, Artificial Sequence
  Synthetic DNA
ttgctgcctccgcacccttttct

SEQ ID NO: 2262 - DNA, 22 bp, Artificial Sequence
  Synthetic DNA
ggaacaccaccaggacctgtaa

SEQ ID NO: 2263 - DNA, 18 bp, Artificial Sequence
  Synthetic DNA
catggcctccgctatgaa

SEQ ID NO: 2264 - DNA, 24 bp, Artificial Sequence
  Synthetic DNA
aggttcattcagctctgtcaccgc

SEQ ID NO: 2265 - DNA, 22 bp, Artificial Sequence
  Synthetic DNA
ggagatttcgatcttcattgga

SEQ ID NO: 2266 - DNA, 18 bp, Artificial Sequence
  Synthetic DNA
ctgcgttcacaccccagt

SEQ ID NO: 2267 - DNA, 24 bp, Artificial Sequence
  Synthetic DNA
tctctccagaacagctcgccctgt

SEQ ID NO: 2268 - DNA, 19 bp, Artificial Sequence
  Synthetic DNA
ctcagccacgacagatggt

SEQ ID NO: 2269 - DNA, 19 bp, Artificial Sequence
  Synthetic DNA
tgctgagcctcctctcctt

SEQ ID NO: 2270 - DNA, 24 bp, Artificial Sequence
  Synthetic DNA
tactcctcatcacagtgcccctgc

SEQ ID NO: 2271 - DNA, 21 bp, Artificial Sequence
  Synthetic DNA
ggatgggggttagtgataagg

SEQ ID NO: 2272 - DNA, 78 bp, Artificial Sequence
  Amplicon Sequence
cgttccgatcctctatactgcatcccaggcatgcctacagcaccctgatgtcgcagcctataaggccaacagggacct

SEQ ID NO: 2273 - DNA, 77 bp, Artificial Sequence
  Amplicon Sequence
aaacaccactggagcattgactaccaggctcgccaatgatgctgctcaagttaaaggggctataggttccaggcttg

SEQ ID NO: 2274 - DNA, 76 bp, Artificial Sequence
  Amplicon Sequence
tgcagactgtaccatgctgaccattgcccatcgcctgcacacggttctaggctccgataggattatggtgctggcc

SEQ ID NO: 2275 - DNA, 71 bp, Artificial Sequence
  Amplicon Sequence
ggatgaacctcgacctgctgcaggagcactcggacgaggctatctgggcagccctggagacggtgcagctc

SEQ ID NO: 2276 - DNA, 69 bp, Artificial Sequence
  Amplicon Sequence
gctaccaagtccgtgctgtttgtgtgtctgggtaacatttgtcgatcacccattgcagaagcagttttc

SEQ ID NO: 2277 - DNA, 67 bp, Artificial Sequence
  Amplicon Sequence
cccatcaacttgtgccagtacagggtctgtgcagtggagtaggcacttcagtggtcgaaccatcacc

SEQ ID NO: 2278 - DNA, 73 bp, Artificial Sequence
  Amplicon Sequence
gaagtgccaggaggcgattaatgctacttgcaaaggcgtgtcctactgcacaggtaatagcagtgagtgcccg

SEQ ID NO: 2279 - DNA, 66 bp, Artificial Sequence
  Amplicon Sequence
ggagaagggtggagtgcagcacccagatggattctgactgtgcggccatccagagacctgaccctg

SEQ ID NO: 2280 - DNA, 76 bp, Artificial Sequence
  Amplicon Sequence
ttgacaacctgctggacatcgaggtggcctacagtctgctcaggggagggtctgatgatagcagcaaggatcccat

SEQ ID NO: 2281 - DNA, 66 bp, Artificial Sequence
  Amplicon Sequence
cttttccctccagtggcacctcctggaaacagtccacttgggcgcaaaacccagtgccttccaaat

SEQ ID NO: 2282 - DNA, 75 bp, Artificial Sequence
  Amplicon Sequence
tagagagcccctgacaatcctgaggcttcatcaggagctagagccatttaacatttcctctttccaagaccaacc

SEQ ID NO: 2283 - DNA, 71 bp, Artificial Sequence
  Amplicon Sequence
cgcttctatggcgctgagattgtgtcagccctggactacctgcactcggagaagaacgtggtgtaccggga

SEQ ID NO: 2284 - DNA, 71 bp, Artificial Sequence
  Amplicon Sequence
tcctgccacccttcaaacctcaggtcacgtccgaggtcgacacaaggtacttcgatgatgaatttaccgcc

SEQ ID NO: 2285 - DNA, 75 bp, Artificial Sequence
  Amplicon Sequence
ttgtctctgccttggactatctacattccggaaagattgtgtaccgtgatctcaagttggagaatctaatgctgg

SEQ ID NO: 2286 - DNA, 67 bp, Artificial Sequence
  Amplicon Sequence
caagaagaggctctaccctgggactgggaatttccaaggccacctttgaggatcgcagagctcattt

SEQ ID NO: 2287 - DNA, 66 bp, Artificial Sequence
  Amplicon Sequence
gaggaatatggaatccaagggggccagttcctgccgtctgctcttctgcctcttgatctccgccac

SEQ ID NO: 2288 - DNA, 74 bp, Artificial Sequence
  Amplicon Sequence
gaaggagataaggaggatgttgacaaggcagtgaaggccgcaagacaggcttttcagattggatctccgtggcg

SEQ ID NO: 2289 - DNA, 69 bp, Artificial Sequence
  Amplicon Sequence
gcctgtacgtgccagctccccgactgccagagcctcaactgtctctgcttcgagatcaagctccgatga

SEQ ID NO: 2290 - DNA, 76 bp, Artificial Sequence
  Amplicon Sequence
gatggttcagctctgcaaggatcgatttgaatatctttccttctcgcccaccacgccgatgagcagccacggtcga

SEQ ID NO: 2291 - DNA, 69 bp, Artificial Sequence
  Amplicon Sequence
ccgtgaaagctgctctgtaaaagctgacacagccctcccaagtgagcaggactgttcttcccactgcaa

SEQ ID NO: 2292 - DNA, 67 bp, Artificial Sequence
  Amplicon Sequence
ctccaggtgtacctccaaccctagccttctcccacagctgcctacaacagagtctcccagccttctc

SEQ ID NO: 2293 - DNA, 67 bp, Artificial Sequence
  Amplicon Sequence
gcccctatcctaccttcaatccatcctcggatgtcgctgccttgcataaggccataatggttaaagg

SEQ ID NO: 2294 - DNA, 71 bp, Artificial Sequence
  Amplicon Sequence
caagacactaagggcgactaccagaaagcgctgctgtacctgtgtggtggagatgactgaagcccgacacg

SEQ ID NO: 2295 - DNA, 67 bp, Artificial Sequence
  Amplicon Sequence
gctcaagcctggaagatgacgtggtgggggacacttcagggtactaccagcggatgttggtggttct

SEQ ID NO: 2296 - DNA, 81 bp, Artificial Sequence
  Amplicon Sequence
gactgcaaagatggaaacgaccttctatgacgatgccctcaacgcctcgttcctcccgtccgagagcggaccttatggcta

SEQ ID NO: 2297 - DNA, 69 bp, Artificial Sequence
  Amplicon Sequence
ggacagcaggaatgtgtttctccatacaggtcacggggagccaatggttcagaaacaaatcgagtgggt

SEQ ID NO: 2298 - DNA, 68 bp, Artificial Sequence
  Amplicon Sequence
gatgaagcctttcgcaagttcctgaagggcctggcttcccgaaagccccttgtgctgtgtggagacct

SEQ ID NO: 2299 - DNA, 67 bp, Artificial Sequence
  Amplicon Sequence
accccggcctgtatatcattgggatcaagaactcgagccattggaaatgcagcaaagagccagatag

SEQ ID NO: 2300 - DNA, 83 bp, Artificial Sequence
  Amplicon Sequence
ccaccttggaccaaagtaaagcgtggaatcgttaccgcctccccaacacgctgaaacccgattcctaccaggtgacgctgaga

SEQ ID NO: 2301 - DNA, 74 bp, Artificial Sequence
  Amplicon Sequence
ggaaacacactggaggacaaggctcgggaactcatcagccgcatcaaacagagtgaactttctgccaagatgcg

SEQ ID NO: 2302 - DNA, 82 bp, Artificial Sequence
  Amplicon Sequence
tgtgagtgaaatgccttctagtagtgaaccgtcctcgggagccgactatgactactcagaagagtatgataacgaaccacaa

SEQ ID NO: 2303 - DNA, 80 bp, Artificial Sequence
  Amplicon Sequence
cgcagtgcagctgagtatctgctcagcagtctaatcaatggcagcttcctggtgcgagaaagtgagagtagccctgggca

SEQ ID NO: 2304 - DNA, 74 bp, Artificial Sequence
  Amplicon Sequence
actggcccacttagtcctcaagctcccaacctgctgtccctcaagccccgcttctaccagcctgtggagttcag

SEQ ID NO: 2305 - DNA, 66 bp, Artificial Sequence
  Amplicon Sequence
gcagccacctgcaactttgcaggcgagagagcatcccgtctacccgcctgagctgtccctcctgga

SEQ ID NO: 2306 - DNA, 65 bp, Artificial Sequence
  Amplicon Sequence
gatgctgccactcaacaacttttgagtcgtggcgtgcgtctaactgagttgctgaagcaaggaca

SEQ ID NO: 2307 - DNA, 66 bp, Artificial Sequence
  Amplicon Sequence
ccgctttcgctacagcatggtggcctactggagacaggctggactcagctacatccgatactccca

SEQ ID NO: 2308 - DNA, 67 bp, Artificial Sequence
  Amplicon Sequence
agctgcagaagagctgcacatttgacgagcagcgaacagccacgatcatggaggagttggcagatgc

SEQ ID NO: 2309 - DNA, 66 bp, Artificial Sequence
  Amplicon Sequence
ggctatgtctttgcaccagccaccagcgccaacgacagtgagatatccagtgatgcgctgacggat

SEQ ID NO: 2310 - DNA, 68 bp, Artificial Sequence
  Amplicon Sequence
ccgtgtgacagcatcgttgtggcgtactacttctgcggggaacccatcccctaccgcaccctggtgag

SEQ ID NO: 2311 - DNA, 80 bp, Artificial Sequence
  Amplicon Sequence
ggctcttgtgcgtactgtccttcgggctggtgacagggaagacatcactgagcctgccatctgtgctcttcgtcatctga

SEQ ID NO: 2312 - DNA, 73 bp, Artificial Sequence
  Amplicon Sequence
gggtcaggtgcctcgagatcgggcttgggcccagagcatgttccagatcccagagtttgagccgagtgagcag

SEQ ID NO: 2313 - DNA, 81 bp, Artificial Sequence
  Amplicon Sequence
cgttgtcagcacttggaatacaagatggttgccgggtcatgttaattgggaaaaagaacagtccacaggaagaggttgaac

SEQ ID NO: 2314 - DNA, 69 bp, Artificial Sequence
  Amplicon Sequence
ctaggggcaaaaagcatgactgctttttcctgtctggcatggaatcacgcagtcaccttgggcatttag

SEQ ID NO: 2315 - DNA, 74 bp, Artificial Sequence
  Amplicon Sequence
gaaagtaagccaggcccagttggaccagaactccctcctggacacatcccaattcaagtgatccgcaaagaggt

SEQ ID NO: 2316 - DNA, 66 bp, Artificial Sequence
  Amplicon Sequence
ccattcccaccattctacctgaggccaggacgtctggggtgtggggattggtgggtctatgttccc

SEQ ID NO: 2317 - DNA, 70 bp, Artificial Sequence
  Amplicon Sequence
ccgccgtggacacagactccccccgagaggtctttttccgagtggcagctgacatgttttctgacggcaa

SEQ ID NO: 2318 - DNA, 83 bp, Artificial Sequence
  Amplicon Sequence
cctggagggtcctgtacaatctcatcatgggactcctgcccttacccaggggccacagagcccccgagatggagcccaattag

SEQ ID NO: 2319 - DNA, 73 bp, Artificial Sequence
  Amplicon Sequence
ccccgagacaacggagataagtgctgttgcggatgccaacggaaagaatcttgggaaagaggccaaacccgag

SEQ ID NO: 2320 - DNA, 73 bp, Artificial Sequence
  Amplicon Sequence
cagatggacctagtacccactgagatttccacgccgaaggacagcgatgggaaaaatgcccttaaatcatagg

SEQ ID NO: 2321 - DNA, 73 bp, Artificial Sequence
  Amplicon Sequence
gctgggatggcttttgtcacttcttcaggaccccctttccactggctttttggagaaaacagctggtccaggc

SEQ ID NO: 2322 - DNA, 69 bp, Artificial Sequence
  Amplicon Sequence
aattaccaagcagccgaagaccacccacgaatggttatcttacgactgttacgttacattgtccgcctg

SEQ ID NO: 2323 - DNA, 73 bp, Artificial Sequence
  Amplicon Sequence
aacccacccctgtcttggagctccgggtagctctcaaactcgaggctgcgcaccccctttcccgtcagctgag

SEQ ID NO: 2324 - DNA, 70 bp, Artificial Sequence
  Amplicon Sequence
cttttgtggaactctatgggaacaatgcagcagccgagagccgaaagggccaggaacgcttcaaccgctg

SEQ ID NO: 2325 - DNA, 74 bp, Artificial Sequence
  Amplicon Sequence
tgtactggcgaagaatatttggtaaagcagggcatcgatctctcaccctggggcttgtggaagaatcacgtggc

SEQ ID NO: 2326 - DNA, 77 bp, Artificial Sequence
  Amplicon Sequence
ccaggaagaatgcttaagatgtgagtggatggatctcaatgacctggcgaagactgaaaatacaactcccatcacca

SEQ ID NO: 2327 - DNA, 66 bp, Artificial Sequence
  Amplicon Sequence
gagctccgcaaggatgacttcaagggtctccagcacctctacgccctcgtcctggtgaacaacaag

SEQ ID NO: 2328 - DNA, 71 bp, Artificial Sequence
  Amplicon Sequence
ggactgtgaggtcaacaacggttccagcctcagggatgagtgcatcacaaacctactggtgtttggcttcc

SEQ ID NO: 2329 - DNA, 70 bp, Artificial Sequence
  Amplicon Sequence
attcctatggctctgcaattgtcaccggttaactgtggcctgtgcccaggaagagccattcactcctgcc

SEQ ID NO: 2330 - DNA, 76 bp, Artificial Sequence
  Amplicon Sequence
cctgcaaaagggaacaagagcccttcgcctccagatggctcccctgccgccacccccgagatcagagtcaaccacg

SEQ ID NO: 2331 - DNA, 77 bp, Artificial Sequence
  Amplicon Sequence
ggttgctgcctccatcaaagatggagaggctgtgtggtttggctgtgatgttggaaaacacttcaatagcaagctgg

SEQ ID NO: 2332 - DNA, 77 bp, Artificial Sequence
  Amplicon Sequence
atgtggacgctctttcaatggacgtgtccccgcgtgcttcttagacggactgcggtctcctaaaggtcgaccatggt

SEQ ID NO: 2333 - DNA, 69 bp, Artificial Sequence
  Amplicon Sequence
gggctagccattgaggtgactcacctccatcagactcggacccaccagggccagcatgtcaggattagc

SEQ ID NO: 2334 - DNA, 69 bp, Artificial Sequence
  Amplicon Sequence
tcgtggaacatgacaaggaattcttccacccacgctaccaccatcgagagttccggtttgatctttcca

SEQ ID NO: 2335 - DNA, 68 bp, Artificial Sequence
  Amplicon Sequence
ttggttcagcgaactattgccaaacagattcagatggtccggcaagttggtaaaggccgatatggaga

SEQ ID NO: 2336 - DNA, 82 bp, Artificial Sequence
  Amplicon Sequence
ccttccgaccagcagatgaagatcatcgaaatcaatttgggcaacgagaccgatcctcatcagctcccaatgtgcatataaa

SEQ ID NO: 2337 - DNA, 65 bp, Artificial Sequence
  Amplicon Sequence
tcagggggctagaaatctgttgctatgggcccttcaccaacatgcccacagatcaactggaatgg

SEQ ID NO: 2338 - DNA, 70 bp, Artificial Sequence
  Amplicon Sequence
agttcgtgctttgcaagatggtgcagagctttatgaagcagtgaagaatgcagcagacccagcttacctt

SEQ ID NO: 2339 - DNA, 79 bp, Artificial Sequence
  Amplicon Sequence
gtgcaggaaaggttcacaaatgtggagtgtctgcgtccaatacacgcgtgtgctcctctccttactccatcgtgtgtgc

SEQ ID NO: 2340 - DNA, 74 bp, Artificial Sequence
  Amplicon Sequence
cagtgatccactttaacaaccctaaagttcaggcatctctggcagcgaacactttcaccattacaggccatgct

SEQ ID NO: 2341 - DNA, 63 bp, Artificial Sequence
  Amplicon Sequence
gttgggacacagttggtctgcagtcggcccaggacggtctactcagcacaactgactgcttca

SEQ ID NO: 2342 - DNA, 68 bp, Artificial Sequence
  Amplicon Sequence
ccgaggttaatccagcacgtatggggccaagtgtaggctcccagcaggaactgagagcgccatgtctt

SEQ ID NO: 2343 - DNA, 82 bp, Artificial Sequence
  Amplicon Sequence
tcaacagaaggctgaaccactagaaagactacagtcccagcaccgacaattccaagctcgagtgtctcggcaaactctgttg

SEQ ID NO: 2344 - DNA, 73 bp, Artificial Sequence
  Amplicon Sequence
ctgaagcagatggttcatcatttcctgggctgttaaacaaagcgaggttaaggttagactcttgggaatcagc

SEQ ID NO: 2345 - DNA, 75 bp, Artificial Sequence
  Amplicon Sequence
ccatctcgctgagatacgaagggagggtgtaccattacaggatcaacactgcttctgatggcaagctctacgtct

SEQ ID NO: 2346 - DNA, 75 bp, Artificial Sequence
  Amplicon Sequence
gaggcaactgcttatggcttaattaagtcagatgcggccatgactgtcgctgtaaagatgctcaagccgagtgcc

SEQ ID NO: 2347 - DNA, 87 bp, Artificial Sequence
  Amplicon Sequence
aactcagacttggaaatgccttctttaacttccacccccctcattggtcacaaattgactgttacaacaccatttcatagagaccag

SEQ ID NO: 2348 - DNA, 74 bp, Artificial Sequence
  Amplicon Sequence
tgaggagtggtattttggcaagatcaccagacgggagtcagagcggttactgctcaatgcagagaacccgagag

SEQ ID NO: 2349 - DNA, 65 bp, Artificial Sequence
  Amplicon Sequence
tcagctgtgagctgcggataccgcccggcaatgggacctgctcttaacctcaaacctaggaccgt

SEQ ID NO: 2350 - DNA, 67 bp, Artificial Sequence
  Amplicon Sequence
ccagcactgctcgttactgtctgccttcagtggtctgaggtcccagtatgaactgccgtgaagtcaa

SEQ ID NO: 2351 - DNA, 67 bp, Artificial Sequence
  Amplicon Sequence
ctacgagtcagcccatccatccatggctaccacttcgacacagcctctcgtaagaaagccgtgggca

SEQ ID NO: 2352 - DNA, 72 bp, Artificial Sequence
  Amplicon Sequence
atcctagccctggtttttggcctcctttttgctgtcaccagcgtcgcgttccttgtgcagatgagaaggcag

SEQ ID NO: 2353 - DNA, 77 bp, Artificial Sequence
  Amplicon Sequence
gaaggccaagaaccgagtcaaattatattccagtttaaggccaatcctcctgctgtgacttttgaactaactgggga

SEQ ID NO: 2354 - DNA, 78 bp, Artificial Sequence
  Amplicon Sequence
cactaaggtttgagacagttccagaaagaacccaagctcaagacgcaggacgagctcagttgtagagggctaattcgc

SEQ ID NO: 2355 - DNA, 68 bp, Artificial Sequence
  Amplicon Sequence
gattgtcactgatggggaggagcctgctgagatgatccaggtcctgggccccaagcctgctctgaagg

SEQ ID NO: 2356 - DNA, 79 bp, Artificial Sequence
  Amplicon Sequence
caagaagctgtacgagctcatcatcacccgctactcggagcccgacctggcggtcgactttgacaatttcgtttgctgc

SEQ ID NO: 2357 - DNA, 70 bp, Artificial Sequence
  Amplicon Sequence
cctcggggatactgtctgatcatcaacaatcacaattttgcaaaagcacgggagaaagtgcccaaacttc

SEQ ID NO: 2358 - DNA, 77 bp, Artificial Sequence
  Amplicon Sequence
tgaatgccgtggattgcacgtggcctcttgagcagtggctggtccagggctagtgacttgtgtcccatgatccctgt

SEQ ID NO: 2359 - DNA, 78 bp, Artificial Sequence
  Amplicon Sequence
atccattcgatctcaccaaggtttggcctcacaaggactaccctctcatcccagttggtaaactggtcttaaaccgga

SEQ ID NO: 2360 - DNA, 74 bp, Artificial Sequence
  Amplicon Sequence
gtggctcaacattgtgttcccatttcagctgatcagtgggcctccaaggaggggctgtaaaatggaggccattg

SEQ ID NO: 2361 - DNA, 72 bp, Artificial Sequence
  Amplicon Sequence
tcattcacaaacctggcagttatatcttccggctgagctgtactcgtctgggtcagtgggctattgggtatg

SEQ ID NO: 2362 - DNA, 69 bp, Artificial Sequence
  Amplicon Sequence
ccatgtgctgtaccaagagtttgctcctggctgctttgatgtcagtgctgctactccacctctgcggcg

SEQ ID NO: 2363 - DNA, 77 bp, Artificial Sequence
  Amplicon Sequence
agcagacagtggtcagtcctttcttggctctgctgacactcgagcccacattccgtcacctgctcagaatcatgcag

SEQ ID NO: 2364 - DNA, 79 bp, Artificial Sequence
  Amplicon Sequence
ccatacctcaagtatttgccatcagttattgctggagctgcctttcatttagcactctacacagtcacgggacaaagct

SEQ ID NO: 2365 - DNA, 84 bp, Artificial Sequence
  Amplicon Sequence
ttcaggttgttgcaggagaccatgtacatgactgtctccattattgatcggttcatgcagaataattgtgtgcccaagaagatg

SEQ ID NO: 2366 - DNA, 73 bp, Artificial Sequence
  Amplicon Sequence
aggcttctgcaggagactctgtacatgtgcgttggcattatggatcgatttttacaggttcagccagtttccc

SEQ ID NO: 2367 - DNA, 69 bp, Artificial Sequence
  Amplicon Sequence
gcatgttcgtggcctctaagatgaaggagaccatccccctgacggccgagaagctgtgcatctacaccg

SEQ ID NO: 2368 - DNA, 76 bp, Artificial Sequence
  Amplicon Sequence
cctctgtgctacagattatacctttgccatgtacccgccatccatgatcgccacgggcagcattggggctgcagtg

SEQ ID NO: 2369 - DNA, 71 bp, Artificial Sequence
  Amplicon Sequence
aaagaagatgatgaccgggtttacccaaactcaacgtgcaagcctcggattattgcaccatccagaggctc

SEQ ID NO: 2370 - DNA, 82 bp, Artificial Sequence
  Amplicon Sequence
atgctgtggctccttcctaactggggctttcttgacatgtaggttgcttggtaataacctttttgtatatcacaatttgggt

SEQ ID NO: 2371 - DNA, 85 bp, Artificial Sequence
  Amplicon Sequence
ggtcaccaagaaacatcagtatgaaattaggaattgttggccacctgtattatctggggggatcagtccttgcattatcattgaa

SEQ ID NO: 2372 - DNA, 64 bp, Artificial Sequence
  Amplicon Sequence
ggatgacatgcactcagctcttggctccactgggatgggaggagaggacaagggaaatgtcagg

SEQ ID NO: 2373 - DNA, 75 bp, Artificial Sequence
  Amplicon Sequence
gcaggtgtcagcaagtatgatcagcaatgaggcggtggtcaatatcctgtcgagctcatcaccacagcggaaaaa

SEQ ID NO: 2374 - DNA, 72 bp, Artificial Sequence
  Amplicon Sequence
gcccagtgcggagaacaggtccagcttgattctcgtctctgcacttaagctgttctccaggtgcgtgtgatt

SEQ ID NO: 2375 - DNA, 81 bp, Artificial Sequence
  Amplicon Sequence
cgtcaggacccaccatgtctgccccatcacgcggccgagacatggcttggccacagctcttgaggatgtcaccaattaacc

SEQ ID NO: 2376 - DNA, 77 bp, Artificial Sequence
  Amplicon Sequence
tccaactaatgccaccaccaaggcggctggtggtgccctgcagtcaacagccagtctcttcgtggtctcactctctc

SEQ ID NO: 2377 - DNA, 66 bp, Artificial Sequence
  Amplicon Sequence
tgtgaaagggaaacacctttgtccaagtcccctatttcccggaccttctaagcccttttgggtgct

SEQ ID NO: 2378 - DNA, 75 bp, Artificial Sequence
  Amplicon Sequence
tgtatttcaagacctctgtgcacttatttatgaacctgccctgctcccacagaacacagcaattcctcaggctaa

SEQ ID NO: 2379 - DNA, 67 bp, Artificial Sequence
  Amplicon Sequence
ccactgcacacacctcagaggctgttcttggggccctacaccttgaggaggggcaggtaaactcctg

SEQ ID NO: 2380 - DNA, 65 bp, Artificial Sequence
  Amplicon Sequence
agatgaagtggaaggcgcttttcaccgcggccatcctgcaggcacagttgccgattacagaggca

SEQ ID NO: 2381 - DNA, 90 bp, Artificial Sequence
  Amplicon Sequence
atcaccgacagcacagacagaatccctgctaccaatatggactccagtcatagtacaacgcttcagcctactgcaaatccaaacacaggt

SEQ ID NO: 2382 - DNA, 78 bp, Artificial Sequence
  Amplicon Sequence
gacgaagacagtccctggatcaccgacagcacagacagaatccctgctaccagagaccaagacacattccaccccagt

SEQ ID NO: 2383 - DNA, 69 bp, Artificial Sequence
  Amplicon Sequence
cacacaaaacagaaccaggactggacccagtggaacccaagccattcaaatccggaagtgctacttcag

SEQ ID NO: 2384 - DNA, 78 bp, Artificial Sequence
  Amplicon Sequence
ctcataccagccatccaatgcaaggaaggacaacaccaagcccagaggacagttcctggactgatttcttcaacccaa

SEQ ID NO: 2385 - DNA, 74 bp, Artificial Sequence
  Amplicon Sequence
tggttcccagccctgtgtccacctccaagcccagattcagattcgagtcatgtacacaacccagggtggaggag

SEQ ID NO: 2386 - DNA, 71 bp, Artificial Sequence
  Amplicon Sequence
ttcagttgctttgcaggaagtgtctagaggaatatggtgggcacagaagtagctctggtgaccttgatcaa

SEQ ID NO: 2387 - DNA, 84 bp, Artificial Sequence
  Amplicon Sequence
gtgcaggctcaggtgaagtgctgcggctgggtcagcttctacaactggacagacaacgctgagctcatgaatcgccctgaggtc

SEQ ID NO: 2388 - DNA, 68 bp, Artificial Sequence
  Amplicon Sequence
agggtgaggtgcttgagtctccaacggcaagggaacaagtacttcttgatacctgggatactgtgccc

SEQ ID NO: 2389 - DNA, 64 bp, Artificial Sequence
  Amplicon Sequence
gggcgtggaacagtttatctcagacatctgccccaagaaggacgtactcgaaaccttcaccgtg

SEQ ID NO: 2390 - DNA, 68 bp, Artificial Sequence
  Amplicon Sequence
gagagcgacgcggttgttgtagctgccgctgcggccgccgcggaataataagccgggatctaccatac

SEQ ID NO: 2391 - DNA, 68 bp, Artificial Sequence
  Amplicon Sequence
tggattggagttctgggaatgtactggccgtggcactggacaacagtgtgtacctgtggagtgcaagc

SEQ ID NO: 2392 - DNA, 71 bp, Artificial Sequence
  Amplicon Sequence
tcttgctggctacgcctcttctgtccctgttagacgtcctccgtccatatcagaactgtgccacaatgcag

SEQ ID NO: 2393 - DNA, 85 bp, Artificial Sequence
  Amplicon Sequence
aaacgagcagtttgccatcagacgcttccagtctatgccggtgaggctgctgggccacagccccgtgcttcggaacatcaccaac

SEQ ID NO: 2394 - DNA, 67 bp, Artificial Sequence
  Amplicon Sequence
ggtgagcagaagtggcctatatcgctccccgtcgatgccagagaacttgaacaggccaagactgaag

SEQ ID NO: 2395 - DNA, 77 bp, Artificial Sequence
  Amplicon Sequence
gcagtccgctgtgttcaatatgatggcaggagggttgttagtggagcatatgattttatggtaaaggtgtgggatcc

SEQ ID NO: 2396 - DNA, 72 bp, Artificial Sequence
  Amplicon Sequence
tccagagactgctgaaaagctggcccgtgacctgaaggctgtcaagtatgtggagtgttctgcacttacaca

SEQ ID NO: 2397 - DNA, 67 bp, Artificial Sequence
  Amplicon Sequence
gagctgaaagacgcacactgtcagaggaaactggccatgcaggaattcatggagatcaatgagcggc

SEQ ID NO: 2398 - DNA, 67 bp, Artificial Sequence
  Amplicon Sequence
gcaacactccccatttacctccttgttctccaccaaagcaaggcaagaaagagaatggtccccctca

SEQ ID NO: 2399 - DNA, 71 bp, Artificial Sequence
  Amplicon Sequence
aagaccgtggatggctacatgaatgaagatgacctgcccagaagccgtcgctccagatcatccgtgaccct

SEQ ID NO: 2400 - DNA, 81 bp, Artificial Sequence
  Amplicon Sequence
tgagtgtcccccggtatcttccccgccctgccaatcccgatgaaattggaaattttattgatgaaaatctgaaagcggctg

SEQ ID NO: 2401 - DNA, 70 bp, Artificial Sequence
  Amplicon Sequence
gtcggcagaagcaggacttgtaccttctgcccatagtgatcagcgatggcggcatcccgcccatgagtag

SEQ ID NO: 2402 - DNA, 71 bp, Artificial Sequence
  Amplicon Sequence
acccatgtaccgtcctcggccagccaacccagatgaaatcggcaactttataattgagaacctgaaggcgg

SEQ ID NO: 2403 - DNA, 78 bp, Artificial Sequence
  Amplicon Sequence
aatgctgcactacgaccctaacaagcggatttcggccaaggcagccctggctcaccctttcttccaggatgtgaccaa

SEQ ID NO: 2404 - DNA, 66 bp, Artificial Sequence
  Amplicon Sequence
agcaacaccagcctcctggccacctcctctccaatgcctgtgaaagaggagtttctgccatagccc

SEQ ID NO: 2405 - DNA, 67 bp, Artificial Sequence
  Amplicon Sequence
gggcaggcaaggtttacactgcggaagccaaaggcagctaagatagaaagctggactgaccaaagac

SEQ ID NO: 2406 - DNA, 71 bp, Artificial Sequence
  Amplicon Sequence
acttgcctgttcagagcactcattccttcccacccccagtcctgtcctatcactctaattcggatttgcca

SEQ ID NO: 2407 - DNA, 72 bp, Artificial Sequence
  Amplicon Sequence
cacagcctcacttctaaccttctggaacccacccaccactgccaagctcactattgaatccacgccattcaa

SEQ ID NO: 2408 - DNA, 65 bp, Artificial Sequence
  Amplicon Sequence
gcaacccacgtgtaactgtcagccgggccctgagtaatcgcttaaagatgttcctacgggcttgt

SEQ ID NO: 2409 - DNA, 77 bp, Artificial Sequence
  Amplicon Sequence
tgacaatcagcacacctgcattcaccgctcggaagagggcctgagctgcatgaataaggatcacggctgtagtcaca

SEQ ID NO: 2410 - DNA, 63 bp, Artificial Sequence
  Amplicon Sequence
taaattcactcgtggtgtggacttcaattggcaagcccaggccctattggccctacaagaggc

SEQ ID NO: 2411 - DNA, 83 bp, Artificial Sequence
  Amplicon Sequence
ggatgctggtgacctcttcttccctcacgttgcaacaggaattaaaggctaaaagaaaacgaagagttacttggtgccttggc

SEQ ID NO: 2412 - DNA, 68 bp, Artificial Sequence
  Amplicon Sequence
ctcccgtcaacagcgttctttccaaacactggaccaggagtgcatccagatgaaggccagactcaccc

SEQ ID NO: 2413 - DNA, 77 bp, Artificial Sequence
  Amplicon Sequence
actttgcgagaaatgggaaccccaatggcgagggtctgccacactggccgctgttcgaccaggaggagcaatacctg

SEQ ID NO: 2414 - DNA, 76 bp, Artificial Sequence
  Amplicon Sequence
ctgaaggagctccaagacctcgctctccaaggcgccaaggagagggcacatcagcagaagaaacacagcggttttg

SEQ ID NO: 2415 - DNA, 80 bp, Artificial Sequence
  Amplicon Sequence
ccaccataggcagaggcaggccttcctacaccctactccctgtgcctccagcctcgactagtccctagcactcgacgact

SEQ ID NO: 2416 - DNA, 72 bp, Artificial Sequence
  Amplicon Sequence
gaggccagtggtggaaacaggtgtggagctgatgagtctgccctaccgcctggtgtttgctgtggcctcgga

SEQ ID NO: 2417 - DNA, 71 bp, Artificial Sequence
  Amplicon Sequence
ctctgtgcgaggctgtcagccacactaggtatcagggatcccgagatgggtaccagcccacagtccttacc

SEQ ID NO: 2418 - DNA, 76 bp, Artificial Sequence
  Amplicon Sequence
aaggaagtggtccctctgtggcaagtgatgaagtctccagctttgcctcagctctcccagacagaaagactgcgtc

SEQ ID NO: 2419 - DNA, 82 bp, Artificial Sequence
  Amplicon Sequence
gataaattggtacaagggatcagcttttcccagcccacatgtcctgatcatatgcttttgaatagtcagttacttggcaccc

SEQ ID NO: 2420 - DNA, 78 bp, Artificial Sequence
  Amplicon Sequence
atgtggaacccccacctacttggcgcctgaagttcttgtttctgttgggactgctgggtataaccgtgctgtggactg

SEQ ID NO: 2421 - DNA, 72 bp, Artificial Sequence
  Amplicon Sequence
tgcctgtggtgggaagctcagtaactgggaaccaaaggatgatgctatgtcagaacaccggaggcattttcc

SEQ ID NO: 2422 - DNA, 86 bp, Artificial Sequence
  Amplicon Sequence
ggatatttccgtggctcttattcaaactctccatcaaatcctgtaaactccagagcaaatcaagatttttctgccttgatgagaag

SEQ ID NO: 2423 - DNA, 78 bp, Artificial Sequence
  Amplicon Sequence
ggtccctaaaacccatctgatgtctgaatctgaatggaggaatcttggcgttcagcagagtcagggatgggtccatta

SEQ ID NO: 2424 - DNA, 62 bp, Artificial Sequence
  Amplicon Sequence
ggctggacgtggttttgtctgctgcgcccgctcttcgcgctctcgtttcattttctgcagcg

SEQ ID NO: 2425 - DNA, 72 bp, Artificial Sequence
  Amplicon Sequence
ggctgctttgctgcaactgtccaccccgcacagacaagccttactccgccaagtattctgctgcccgctctg

SEQ ID NO: 2426 - DNA, 73 bp, Artificial Sequence
  Amplicon Sequence
tctgggaggtgccctactttgctgttcctgtccccgaaaaacaacctcttacccaacaccaaggccctatcca

SEQ ID NO: 2427 - DNA, 74 bp, Artificial Sequence
  Amplicon Sequence
ggtctgccctagtcatcctgggaggtgcactgctctcctgttcctgtcctgggaatgagagcaaggctgggtac

SEQ ID NO: 2428 - DNA, 68 bp, Artificial Sequence
  Amplicon Sequence
cggtacttgagcaatgcctacgcccgggaagaattcgcttccacctgtccagatgatgaggagatcga

SEQ ID NO: 2429 - DNA, 67 bp, Artificial Sequence
  Amplicon Sequence
accgtatggacagccacagcctggctttgggtacagcatgtgagatgaagcgctgatcctgtagtca

SEQ ID NO: 2430 - DNA, 76 bp, Artificial Sequence
  Amplicon Sequence
ccccaggatacctaccactacctgcccttcagcctgccccaccggaggcctcacttcttctttcccaagtcccgca

SEQ ID NO: 2431 - DNA, 86 bp, Artificial Sequence
  Amplicon Sequence
gacatttccagtcctgcagtcaatgcctctctgccccaccctttgttcagtgtggctggtgccacgacaaatgtgtgcgatcggag

SEQ ID NO: 2432 - DNA, 84 bp, Artificial Sequence
  Amplicon Sequence
tccctccactcggaaggactatcctgctgccaagagggtcaagttggacagtgtcagagtcctgagacagatcagcaacaaccg

SEQ ID NO: 2433 - DNA, 64 bp, Artificial Sequence
  Amplicon Sequence
tccaccctcctggctttggccagcatggcgaagacgaaaggaaacaaggtgaacgtgggagtga

SEQ ID NO: 2434 - DNA, 68 bp, Artificial Sequence
  Amplicon Sequence
gtggccatccagctgaccttcctgcgcctgatgtccaccgaggcctcccagaacatcacctaccactg

SEQ ID NO: 2435 - DNA, 80 bp, Artificial Sequence
  Amplicon Sequence
cagccaagaactggtataggagctccaaggacaagaaacacgtctggctaggagaaactatcaatgctggcagccagttt

SEQ ID NO: 2436 - DNA, 72 bp, Artificial Sequence
  Amplicon Sequence
atgcccagtgttcctgacttcgaaacgctattctcacaggttcagctcttcatcagcacttgtaatggggag

SEQ ID NO: 2437 - DNA, 79 bp, Artificial Sequence
  Amplicon Sequence
tctgcagagttggaagcactctatggtgacatcgatgctgtggagctgtatcctgcccttctggtagaaaagcctcggc

SEQ ID NO: 2438 - DNA, 80 bp, Artificial Sequence
  Amplicon Sequence
tcgagtctcccttcaccatttccgacggcatctacggctcaacattttttgtagccacaggcttccacggacttcacgtc

SEQ ID NO: 2439 - DNA, 73 bp, Artificial Sequence
  Amplicon Sequence
cgtgagtacacagatgcctccttcacaaatcgaaaggagagaggccctgaagaagagcatcttggcatcctgg

SEQ ID NO: 2440 - DNA, 70 bp, Artificial Sequence
  Amplicon Sequence
tggtctgcaagcaagtattcaagaaggtgcagtgaggcccaagcagacaaccttgtcccaaccaatcagc

SEQ ID NO: 2441 - DNA, 82 bp, Artificial Sequence
  Amplicon Sequence
tgggaagcagctgtgtaccattcctcgcgatgctgcctactacagctatcagaataggtatcatttctgtgagaagtgtttc

SEQ ID NO: 2442 - DNA, 76 bp, Artificial Sequence
  Amplicon Sequence
gtgctacgccaccctgttcggacccaaaggcgtgaacatcgggggcgcgggctcctacatctacgagaagcccctg

SEQ ID NO: 2443 - DNA, 65 bp, Artificial Sequence
  Amplicon Sequence
gggtctgtgccccatgacacctggctgcccaagaagtgttccctgtgtaaatgctggcacggtca

SEQ ID NO: 2444 - DNA, 75 bp, Artificial Sequence
  Amplicon Sequence
ctccctaacctccagaatgggcccatatatgccagggttatccagaagcgagtccccaatgcctacgacaagaca

SEQ ID NO: 2445 - DNA, 72 bp, Artificial Sequence
  Amplicon Sequence
aaggtttttggattgcaaggggtttccaggggcatgtatgacggtcctgtgtacgaggtaccagctacaccc

SEQ ID NO: 2446 - DNA, 69 bp, Artificial Sequence
  Amplicon Sequence
gatgtgattgaggtgcatggaaaacatgaagagcgccaggatgaacatggtttcatctccagggagttc

SEQ ID NO: 2447 - DNA, 72 bp, Artificial Sequence
  Amplicon Sequence
ttacgcagctcatgctcttgaacggctctttactatgcgagggcctaacaatgccactctctttacagctgc

SEQ ID NO: 2448 - DNA, 74 bp, Artificial Sequence
  Amplicon Sequence
tgcagcggctgattgacagtcagatggagacctcgtgccaaattacatttgagtttgtagaccaggaacagttg

SEQ ID NO: 2449 - DNA, 64 bp, Artificial Sequence
  Amplicon Sequence
cctgaacatgaaggagctgaagctgctgcagaccatcgggaagggggagttcggagacgtgatg

SEQ ID NO: 2450 - DNA, 72 bp, Artificial Sequence
  Amplicon Sequence
gctctccatcagctcctgtctccagcagctttccctgttgatgtggatcacgcagtgctttctgcccgtgtt

SEQ ID NO: 2451 - DNA, 76 bp, Artificial Sequence
  Amplicon Sequence
gagttcaagtgccctgacggcgaggtcatgaagaagaacatgatgttcatcaagacctgtgcctgccattacaact

SEQ ID NO: 2452 - DNA, 67 bp, Artificial Sequence
  Amplicon Sequence
gctcacttcggctaaaatgcagaaatgcatgctgtcagcgttggtatttcacattcaatggagctga

SEQ ID NO: 2453 - DNA, 70 bp, Artificial Sequence
  Amplicon Sequence
cactgaggtccgggtgacagtgcttcggcaggctgacagccaggtgactgaagtctgtgcggcaacctac

SEQ ID NO: 2454 - DNA, 67 bp, Artificial Sequence
  Amplicon Sequence
gttttccaggtcggagacggaagaccggaggcagtagctgcaaagcccttggaacaccctggatgct

SEQ ID NO: 2455 - DNA, 62 bp, Artificial Sequence
  Amplicon Sequence
ggccgagatctacaaaaacggccccgtggagggagctttctctgtgtattcggacttcctgc

SEQ ID NO: 2456 - DNA, 80 bp, Artificial Sequence
  Amplicon Sequence
gtacatgatcccctgtgagaaggtgtccaccctgcccgcgatcacactgaagctgggaggcaaaggctacaagctgtccc

SEQ ID NO: 2457 - DNA, 77 bp, Artificial Sequence
  Amplicon Sequence
gcaagttccaacctggaaaggccatcggctttgtcaaggatgtagccaacatcacaatctatgacgaggaagcgatg

SEQ ID NO: 2458 - DNA, 74 bp, Artificial Sequence
  Amplicon Sequence
gggaggcttatctcactgagtgagcagaatctggtagactgctctgggcctcaaggcaatgaaggctgcaatgg

SEQ ID NO: 2459 - DNA, 67 bp, Artificial Sequence
  Amplicon Sequence
tgtctcactgagcgagcagaatctggtggactgttcgcgtcctcaaggcaatcagggctgcaatggt

SEQ ID NO: 2460 - DNA, 71 bp, Artificial Sequence
  Amplicon Sequence
atgccctggtaatgtctgcattcaacaatgacgctggctttgtggctgctcttgataaggcttgtggtcgc

SEQ ID NO: 2461 - DNA, 75 bp, Artificial Sequence
  Amplicon Sequence
aagcatcttcctgttcttggaccgcacctatgtgctgcagaactccacgctgccctccatctgggatatgggatt

SEQ ID NO: 2462 - DNA, 67 bp, Artificial Sequence
  Amplicon Sequence
gagctacagatgcccatgccgattcttcgaaagccatgttgccagagccaacgtcaagcatctcaaa

SEQ ID NO: 2463 - DNA, 72 bp, Artificial Sequence
  Amplicon Sequence
tgaccgcttctaccccaatgacttgtgggtggttgtgttccagtttcagcacatcatggttggccttatcct

SEQ ID NO: 2464 - DNA, 77 bp, Artificial Sequence
  Amplicon Sequence
ggtgcctactccattgtggcgggcgtgtttgtgtgcctgctggagtacccccgggggaagaggaagaagggctccac

SEQ ID NO: 2465 - DNA, 71 bp, Artificial Sequence
  Amplicon Sequence
ccagctttgtgcctgtcactattcctcatgccaccactgccaacacctctgtcttgggctaccacattccc

SEQ ID NO: 2466 - DNA, 73 bp, Artificial Sequence
  Amplicon Sequence
ccgtgttcaagaggaagctcactgccttgtggaggagttgagaaaaaccaaggcttcaccctgtgatcccact

SEQ ID NO: 2467 - DNA, 79 bp, Artificial Sequence
  Amplicon Sequence
agaacaaggacaacatagatccttacatatacacaccctttggaagtggacccagaaactgcattggcatgaggtttgc

SEQ ID NO: 2468 - DNA, 76 bp, Artificial Sequence
  Amplicon Sequence
tgctcattcttgaggagcattaaggtatttcgaaactgccaagggtgctggtgcggatggacactaatgcagccac

SEQ ID NO: 2469 - DNA, 77 bp, Artificial Sequence
  Amplicon Sequence
cgctgacatcatgaatgttcctcgaccggctggaggcgagtttggatatgacaaagacacatcgttgctgaaagaga

SEQ ID NO: 2470 - DNA, 75 bp, Artificial Sequence
  Amplicon Sequence
aaatgtcctcctcgactgctccgcggagtccgaccgaggagttccagtgatcaagtggaagaaagatggcattca

SEQ ID NO: 2471 - DNA, 66 bp, Artificial Sequence
  Amplicon Sequence
ggtcaccgttggtgtcatcacagtgctggtagtggtcatcgtggctgtgatttgcacccgacgctc

SEQ ID NO: 2472 - DNA, 74 bp, Artificial Sequence
  Amplicon Sequence
atggagatgtggtcattcctagtgattattttcagatagtgggaggaagcaacttacggatacttggggtggtg

SEQ ID NO: 2473 - DNA, 110 bp, Artificial Sequence
  Amplicon Sequence
gccgccacaagactaaggaatggccaccccgcccaagagaagctgcccgtctttctcagccagctctgaggggacccgcatcaagaaaatctccatcgaagggaacatcg

SEQ ID NO: 2474 - DNA, 68 bp, Artificial Sequence
  Amplicon Sequence
tgcggatcatccggaatggaattggaatccacgagcatgccagcattgacttaccaggcatcaaagga

SEQ ID NO: 2475 - DNA, 70 bp, Artificial Sequence
  Amplicon Sequence
cttgtggagatcacccaatcaggttctatgcccgggactcgggcctgctcaagtttgagatccaggcggg

SEQ ID NO: 2476 - DNA, 73 bp, Artificial Sequence
  Amplicon Sequence
ttgctataactaagtgcttctccaagaccccaactgagtccccagcacctgctacagtgagctgccattccac

SEQ ID NO: 2477 - DNA, 78 bp, Artificial Sequence
  Amplicon Sequence
gggagaacgggatcaataggatcggaaacctgctggtgcccaatgagaattactgcaagtttgaggactggctgatgc

SEQ ID NO: 2478 - DNA, 73 bp, Artificial Sequence
  Amplicon Sequence
cacaatggcggctctgaagagttggctgtcgcgcagcgtaacttcattcttcaggtacagacagtgtttgtgt

SEQ ID NO: 2479 - DNA, 62 bp, Artificial Sequence
  Amplicon Sequence
caagcagtcaaggagaaccagaagcggcgggagacagaagaaaagatgaggcgagcaaaact

SEQ ID NO: 2480 - DNA, 68 bp, Artificial Sequence
  Amplicon Sequence
tccaattccagcatcactgtggagaaaagctgtttgtctccccagcatactttatcgccttcactgcc

SEQ ID NO: 2481 - DNA, 70 bp, Artificial Sequence
  Amplicon Sequence
tgacaactaccagccgtacccgtgcgcagaggacgaggagtgcggcactgatgagtactgcgctagtccc

SEQ ID NO: 2482 - DNA, 68 bp, Artificial Sequence
  Amplicon Sequence
gattcagacgaggatgagccttgtgccatcagtggcaaatggactttccaaagggacagcaagaggtg

SEQ ID NO: 2483 - DNA, 87 bp, Artificial Sequence
  Amplicon Sequence
aggacgcaaggagggtttgtcactggcagactcgagactgtaggcactgccatggcccctgtgctcagtaaggactcggcggacatc

SEQ ID NO: 2484 - DNA, 83 bp, Artificial Sequence
  Amplicon Sequence
tgcacagagggtgtgggttacaccaatgcttccaacaatttgtttgcttgcctcccatgtacagcttgtaaatcagatgaaga

SEQ ID NO: 2485 - DNA, 84 bp, Artificial Sequence
  Amplicon Sequence
ctctgagacagtgcttcgatgactttgcagacttggtgccctttgactcctgggagccgctcatgaggaagttgggcctcatgg

SEQ ID NO: 2486 - DNA, 67 bp, Artificial Sequence
  Amplicon Sequence
cctggatctcccaggtatcattgaaggtgccaaggatgggaaaggtagaggtcgtcaagtcattgca

SEQ ID NO: 2487 - DNA, 73 bp, Artificial Sequence
  Amplicon Sequence
tggcactactgcatgattgacatagagaagatcagggccatgacaatcgccaagctgaaaacaatgcggcagg

SEQ ID NO: 2488 - DNA, 78 bp, Artificial Sequence
  Amplicon Sequence
aaatcgctgggaacaagtgccgttaattaaggaaaagttgagccagggcgtgaccctcgtcgtggacagatacgcatt

SEQ ID NO: 2489 - DNA, 76 bp, Artificial Sequence
  Amplicon Sequence
agacatcagctcctggttcaacgaggccattgacttcatagactccatcaagaatgctggaggaagggtgtttgtc

SEQ ID NO: 2490 - DNA, 76 bp, Artificial Sequence
  Amplicon Sequence
tatccctgtggaggacaaccagatggtggagatcagtgcctggttccaggaggccataggcttcattgactgggtg

SEQ ID NO: 2491 - DNA, 67 bp, Artificial Sequence
  Amplicon Sequence
acacatggagtgcttctggaactatcagcccacttgaccacccagtttgtggaagcacaggcaagag

SEQ ID NO: 2492 - DNA, 79 bp, Artificial Sequence
  Amplicon Sequence
agcatgacacggagatgaagtactatatagtacacctgaagcggcacttcatgttccggaaccacctgtgcctggtatt

SEQ ID NO: 2493 - DNA, 75 bp, Artificial Sequence
  Amplicon Sequence
actccctctacccttgagcaagggcaggggtccctgagctgttcttctgccccatactgaaggaactgaggcctg

SEQ ID NO: 2494 - DNA, 73 bp, Artificial Sequence
  Amplicon Sequence
tgccacctggacatcatttgggtcaacactcccgagcacgttgttccgtatggacttggaagccctaggtcca

SEQ ID NO: 2495 - DNA, 68 bp, Artificial Sequence
  Amplicon Sequence
tacatctccaaacccatccaccagcatgaagaccgctgcttgaggttgaaggtgactgtcagtggcaa

SEQ ID NO: 2496 - DNA, 67 bp, Artificial Sequence
  Amplicon Sequence
actacatctccacgcccactcacaacctgcactggaagtgtctgaggatgaaggtgttcgtctgctg

SEQ ID NO: 2497 - DNA, 66 bp, Artificial Sequence
  Amplicon Sequence
ggagcccgtatcctggagctccctcaaccccaagttcctgagtgggaagggcttggtgatctatcc

SEQ ID NO: 2498 - DNA, 73 bp, Artificial Sequence
  Amplicon Sequence
tgacattatcatcccgctaaggactgcggacagcgtcttctgccctcactacgagaaggtcagcggggactac

SEQ ID NO: 2499 - DNA, 74 bp, Artificial Sequence
  Amplicon Sequence
ttgaacagagcctgaccaagagggatgagttcgagtttctggagaaagcatcaaaactgcgaggaatctcaaca

SEQ ID NO: 2500 - DNA, 62 bp, Artificial Sequence
  Amplicon Sequence
tgtcgatggacttccagaaccacctgggcagctgccaaaagtgtgatccaagctgtcccaat

SEQ ID NO: 2501 - DNA, 79 bp, Artificial Sequence
  Amplicon Sequence
tcaatggccggacgaaagccatggttgcttgttatccgggcaatggaacgggttatgtacgtcatgttgataatccaaa

SEQ ID NO: 2502 - DNA, 68 bp, Artificial Sequence
  Amplicon Sequence
gctggtcctctactgcgggagccggctgggcaaatactacgtcaaggagaggtctaaggcaatggtgg

SEQ ID NO: 2503 - DNA, 76 bp, Artificial Sequence
  Amplicon Sequence
gtccccgctgcagatctctgacccgttcggatcctttcctcactcgcccaccatggacaactaccctaagctggag

SEQ ID NO: 2504 - DNA, 78 bp, Artificial Sequence
  Amplicon Sequence
ccatgtggatgaatgaggtgtctcctttccatacccagtctcaccttctccccaccctacctcacctcttctcaggca

SEQ ID NO: 2505 - DNA, 72 bp, Artificial Sequence
  Amplicon Sequence
aaagtggtgaatgccatttggtttcaggatatagctgacctggcatttgaggtatcagggaggaagcctcac

SEQ ID NO: 2506 - DNA, 82 bp, Artificial Sequence
  Amplicon Sequence
gatctaagatggcgactgtcgaaccggaaaccacccctactcctaatcccccgactacagaagaggagaaaacggaatctaa

SEQ ID NO: 2507 - DNA, 67 bp, Artificial Sequence
  Amplicon Sequence
aagccgcggttgaatgtgccatgaccctctccctctctggatggcaccatcattgaagctggcgtca

SEQ ID NO: 2508 - DNA, 77 bp, Artificial Sequence
  Amplicon Sequence
gacaggaggcctctatcctgtccctccaccccaccctccacctcaatcccctcccatcttccccagacctacctcac

SEQ ID NO: 2509 - DNA, 75 bp, Artificial Sequence
  Amplicon Sequence
gctagtactttgatgctcccttgatggggtccagagagcctccctgcagccaccagacttggcctccagctgttc

SEQ ID NO: 2510 - DNA, 69 bp, Artificial Sequence
  Amplicon Sequence
tggcctacctcttcaccatcatcaacagcctccaaggcttcttcatcttcttggtctactgcctcctca

SEQ ID NO: 2511 - DNA, 68 bp, Artificial Sequence
  Amplicon Sequence
ggcagtgtcactgagtccttgaaatcctcccctgccccgcgggtctctggattgggacgcacagtgca

SEQ ID NO: 2512 - DNA, 68 bp, Artificial Sequence
  Amplicon Sequence
caaggccgtgaacgagaagtcctgcaactgcctcctgctcaaagtcaaccagattggctccgtgaccg

SEQ ID NO: 2513 - DNA, 75 bp, Artificial Sequence
  Amplicon Sequence
agccccagcaactacagtctgggatgccaaggccagccatgatgtcagtggcccagcatggtcaacctttgaaca

SEQ ID NO: 2514 - DNA, 72 bp, Artificial Sequence
  Amplicon Sequence
aagccttggagggtttcattgccgtggtgacccaagatggcgacatgatctttctgtcagaaaacatcagca

SEQ ID NO: 2515 - DNA, 75 bp, Artificial Sequence
  Amplicon Sequence
gggccctccagaacaatgatgggctttatgatcctgactgcgatgagagcgggctctttaaggccaagcagtgca

SEQ ID NO: 2516 - DNA, 72 bp, Artificial Sequence
  Amplicon Sequence
cgcctgttcaccaagattgacaccattgcgcccgatgagatcaccgtcagcagcgacttcgaggcacgccac

SEQ ID NO: 2517 - DNA, 66 bp, Artificial Sequence
  Amplicon Sequence
caaccaggcagctccatcggcagtgtccatcatgcatcaggtgagccgcaccgtggacagcattac

SEQ ID NO: 2518 - DNA, 77 bp, Artificial Sequence
  Amplicon Sequence
tgaacggggtatcctccttagccacggggcccgtcccatttgagcctgtcaatgtcaccactgaccgagaggtacct

SEQ ID NO: 2519 - DNA, 69 bp, Artificial Sequence
  Amplicon Sequence
actggtcctccatcggctccccaggagctttggtttgaggtgcaaggctcagcactcatgctacactgg

SEQ ID NO: 2520 - DNA, 67 bp, Artificial Sequence
  Amplicon Sequence
actgtggcacttaggggagatgacatttgctttgggcagaggcagctagccaggacacatttccact

SEQ ID NO: 2521 - DNA, 81 bp, Artificial Sequence
  Amplicon Sequence
cggttatgtcatgccagatacacacctcaaaggtactccctcctcccgggaaggcaccctttcttcagtgggtctcagttc

SEQ ID NO: 2522 - DNA, 67 bp, Artificial Sequence
  Amplicon Sequence
gtccaggtggatgtgaaagatccccagcaggccctcaaggagctggctaagatgtgtatcctggccg

SEQ ID NO: 2523 - DNA, 69 bp, Artificial Sequence
  Amplicon Sequence
tggccttcttcaccagctaccagtacatggagagcaccgtggcctcctggtatgagcaggggatccttg

SEQ ID NO: 2524 - DNA, 91 bp, Artificial Sequence
  Amplicon Sequence
ataacaaagtgtagctctgacatgaatggctattgtttgcatggacagtgcatctatctggtggacatgagtcaaaactactgcaggtgtg

SEQ ID NO: 2525 - DNA, 67 bp, Artificial Sequence
  Amplicon Sequence
acggatcacagtggaggaagcgctggctcacccctacctggagcagtactatgacccgacggatgag

SEQ ID NO: 2526 - DNA, 68 bp, Artificial Sequence
  Amplicon Sequence
agttcttgacccctggtcctgtctccagcccgtcttggcttatccactttgactcctttgagccgttt

SEQ ID NO: 2527 - DNA, 70 bp, Artificial Sequence
  Amplicon Sequence
acccccagaccggatcaggcaagctggccctcatgtccccttcacggtgtttgaggaagtctgccctaca

SEQ ID NO: 2528 - DNA, 68 bp, Artificial Sequence
  Amplicon Sequence
cgtggtgcccctctatgacctgctgctggagatgctggacgcccaccgcctacatgcgcccactagcc

SEQ ID NO: 2529 - DNA, 67 bp, Artificial Sequence
  Amplicon Sequence
tccagtgcctatgacccccccagacaaatcgccatcaagtcccctgcccctggtgcccttggacagt

SEQ ID NO: 2530 - DNA, 73 bp, Artificial Sequence
  Amplicon Sequence
gtgaaggatgtgaagcagacgtacttggcacgggtcttctcctacccggcagggaatgtggagagcaccggtt

SEQ ID NO: 2531 - DNA, 66 bp, Artificial Sequence
  Amplicon Sequence
gctttgccaccaggaaagtggctggcatggccaaacctaacatgatcatcagtgtgaatggggatg

SEQ ID NO: 2532 - DNA, 66 bp, Artificial Sequence
  Amplicon Sequence
ctgaccagaaccacggcttatccggcctgtccacgaaccacttatacacccacatgacccacttcc

SEQ ID NO: 2533 - DNA, 91 bp, Artificial Sequence
  Amplicon Sequence
ggattgctcaacaaccatgctgggcatctggaccctcctacctctggttcttacgtctgttgctagattatcgtccaaaagtgttaatgcc

SEQ ID NO: 2534 - DNA, 80 bp, Artificial Sequence
  Amplicon Sequence
gcactttgggattctttccattatgattctttgttacaggcaccgagaatgttgtattcagtgagggtcttcttacatgc

SEQ ID NO: 2535 - DNA, 66 bp, Artificial Sequence
  Amplicon Sequence
gcctcttcctgttcgacggctcgcccacctacgtactggcctacacccagagctaccgggcaaagc

SEQ ID NO: 2536 - DNA, 90 bp, Artificial Sequence
  Amplicon Sequence
ggctattcctcattttctctacaaagtggcctcagtgaacatgaagaaggtagcctcctggaggagaatttcggtgacagtctacaatcc

SEQ ID NO: 2537 - DNA, 73 bp, Artificial Sequence
  Amplicon Sequence
ccccagtttcaacgagacttcatttcattgctccctaaagagttggcactctatgtgctttcattcctggaac

SEQ ID NO: 2538 - DNA, 71 bp, Artificial Sequence
  Amplicon Sequence
gagatgattcagttaccgggagcccggcccattttggatcctgtggatttcttgggtctccaggacaagat

SEQ ID NO: 2539 - DNA, 68 bp, Artificial Sequence
  Amplicon Sequence
ctctgcaggcctaggtgcagctcctcagcggctccagctcatatgctgacagctcttcacagtcctgg

SEQ ID NO: 2540 - DNA, 68 bp, Artificial Sequence
  Amplicon Sequence
cggtagtcaagtccggatcaagggcaaggagacggaattctacctgtgcatgaaccgcaaaggcaagc

SEQ ID NO: 2541 - DNA, 76 bp, Artificial Sequence
  Amplicon Sequence
agatgcaggagagaggaagccttgcaaacctgcagactgctttttgcccaatatagattgggtaaggctgcaaaac

SEQ ID NO: 2542 - DNA, 74 bp, Artificial Sequence
  Amplicon Sequence
cacgggacattcaccacatcgactactataaaaagacaaccaacggccgactgcctgtgaagtggatggcaccc

SEQ ID NO: 2543 - DNA, 80 bp, Artificial Sequence
  Amplicon Sequence
gagggactgttggcatgcagtgccctcccagagaccaacgttcaagcagttggtagaagacttggatcgaattctcactc

SEQ ID NO: 2544 - DNA, 67 bp, Artificial Sequence
  Amplicon Sequence
ccagtggagcgcttccatgacctgcgtcctgatgaagtggccgatttgtttcagacgacccagagag

SEQ ID NO: 2545 - DNA, 72 bp, Artificial Sequence
  Amplicon Sequence
ggttccagctttctgtagctgtaagcattggtggccacaccacctccttacaaagcaactagaacctgcggc

SEQ ID NO: 2546 - DNA, 66 bp, Artificial Sequence
  Amplicon Sequence
ccaccagcatgaagtttcggacagacatggcctttgtgaggggttccagttgtgcttcagacagcc

SEQ ID NO: 2547 - DNA, 73 bp, Artificial Sequence
  Amplicon Sequence
gccacacaaacatgctcctgctcctggcggaggcagagctgctgggaaagacatttcggaagtttcctgtggc

SEQ ID NO: 2548 - DNA, 75 bp, Artificial Sequence
  Amplicon Sequence
ggctcccgaatctatctttgacaaaatctacagcaccaagagcgacgtgtggtcttacggagtattgctgtggga

SEQ ID NO: 2549 - DNA, 69 bp, Artificial Sequence
  Amplicon Sequence
accaagaagctgaggacctgtggctgagcccgctgaccatggaagatcttgtctgctacagcttccagg

SEQ ID NO: 2550 - DNA, 67 bp, Artificial Sequence
  Amplicon Sequence
cgagccctttgatgacttcctgttcccagcatcatccaggcccagtggctctgagacagcccgctcc

SEQ ID NO: 2551 - DNA, 83 bp, Artificial Sequence
  Amplicon Sequence
tgaagtccaggacgatgatgcgcctctctcgcccatgctctacagcagctcagccagcctgtcaccttcagtaagcaagccgt

SEQ ID NO: 2552 - DNA, 66 bp, Artificial Sequence
  Amplicon Sequence
cagccctgccagtttgactatgccgtcttctgccctaacctgacagaggtgtcatccacaggcaac

SEQ ID NO: 2553 - DNA, 75 bp, Artificial Sequence
  Amplicon Sequence
ttggtacctgtgggttagcatcaagttctccccagggtagaattcaatcagagctccagtttgcatttggatgtg

SEQ ID NO: 2554 - DNA, 72 bp, Artificial Sequence
  Amplicon Sequence
gtaagtcggatgagcctgtctgtgccagtgacaatgccacttatgccagcgagtgtgccatgaaggaagctg

SEQ ID NO: 2555 - DNA, 95 bp, Artificial Sequence
  Amplicon Sequence
aagtcctcgatacgcactatagcaccgagaatgacgtggagaccatccgggccagcgtctgcgccccctgccacgcctcatgtgccacatgccag

SEQ ID NO: 2556 - DNA, 80 bp, Artificial Sequence
  Amplicon Sequence
ggataattcagacaacaacaccatctttgtgcaaggcctgggtgagaatgttacaattgagtctgtggctgattacttca

SEQ ID NO: 2557 - DNA, 66 bp, Artificial Sequence
  Amplicon Sequence
ccgtgctcattgctaaccactgtctgtccctgaactcccagaaccactacatctggctttgggcag

SEQ ID NO: 2558 - DNA, 73 bp, Artificial Sequence
  Amplicon Sequence
cagttcggtccaacagagaaagcaggcaaccaccatgtcatttgaaaacagtttcatcgggatataattcgca

SEQ ID NO: 2559 - DNA, 66 bp, Artificial Sequence
  Amplicon Sequence
cgtgtgtctcaagacgatcccactgtgtaccctaatgggtcccgcttcccagacagcacagggacc

SEQ ID NO: 2560 - DNA, 67 bp, Artificial Sequence
  Amplicon Sequence
agagcaccaaagcagctcatcccactgatgacaccacgacgctctctgagagaccatccccaagcac

SEQ ID NO: 2561 - DNA, 69 bp, Artificial Sequence
  Amplicon Sequence
gaagcgcagatcatgaagaagctgaagcacgacaagctggtccagctctatgcagtggtgtctgaggag

SEQ ID NO: 2562 - DNA, 75 bp, Artificial Sequence
  Amplicon Sequence
ggtgcaccagttctaccctctagtgaaagtgcagtgttccgctgagctcaagttcttcctgtgctccatgtacgc

SEQ ID NO: 2563 - DNA, 78 bp, Artificial Sequence
  Amplicon Sequence
tggatcctcacctggtcggtgctgtgctgcgcttccaccttcttcactgtcaccacgtacttggtagacatgcagcgc

SEQ ID NO: 2564 - DNA, 67 bp, Artificial Sequence
  Amplicon Sequence
aatgagagaggtgaaagcggacggagctagcacccccaggttaagagaacaggactgtggtgaacct

SEQ ID NO: 2565 - DNA, 68 bp, Artificial Sequence
  Amplicon Sequence
tcagcagcaagggcatcatggaggaggatgaggcctgcgggcgccagtacacgctcaagaaaaccacc

SEQ ID NO: 2566 - DNA, 61 bp, Artificial Sequence
  Amplicon Sequence
caacgaattccaggtgtccctgagcagctccatgtcggtgtcagagctgaaggcgcagatc

SEQ ID NO: 2567 - DNA, 73 bp, Artificial Sequence
  Amplicon Sequence
gtgctggtgacgaatccacattcatctcaatggaaggatcctgccttaagtcaacttatttgtttttgccggg

SEQ ID NO: 2568 - DNA, 70 bp, Artificial Sequence
  Amplicon Sequence
accctcgacaagaccacactttgggacttgggagctggggctgaagttgctctgtacccatgaactccca

SEQ ID NO: 2569 - DNA, 66 bp, Artificial Sequence
  Amplicon Sequence
cgcgctgcagatccattttacgctgatccaggctttctgctgcgagaacgacatcgacatagtgcg

SEQ ID NO: 2570 - DNA, 74 bp, Artificial Sequence
  Amplicon Sequence
ggaacagggtcacccacagactgggtgtgagtgtgaagatggtcctgatgggcaggagatggacccgccaaatc

SEQ ID NO: 2571 - DNA, 73 bp, Artificial Sequence
  Amplicon Sequence
ttgggaaatatttgggcattggtctggccaagtctacaatgtcccaatatcaaggacaaccaccctagcttct

SEQ ID NO: 2572 - DNA, 83 bp, Artificial Sequence
  Amplicon Sequence
gcatgggaaccatcaaccagcaggccatggaccaacttcactatgtgacagagctgacagatcgaatcaaggcaaactcctca

SEQ ID NO: 2573 - DNA, 71 bp, Artificial Sequence
  Amplicon Sequence
ctgttgcaggaaggcattgatcatctcctggcccagcatgttgctcatctctttattagagacccactgac

SEQ ID NO: 2574 - DNA, 85 bp, Artificial Sequence
  Amplicon Sequence
tgtagaatcaaactcttcatcatcaactagaagtgcagttgacatggcctgttcagtccttggagttgcacagctggattctgtg

SEQ ID NO: 2575 - DNA, 75 bp, Artificial Sequence
  Amplicon Sequence
tggtgcttggagcatagaagactgcccttcacaaaggaaatccctgattattgtttgaaatgctgaggacgttgc

SEQ ID NO: 2576 - DNA, 72 bp, Artificial Sequence
  Amplicon Sequence
cgctccagacctatgatgacttgttagccaaagactgccactgcatatgagcagtcctggtccttccactgt

SEQ ID NO: 2577 - DNA, 71 bp, Artificial Sequence
  Amplicon Sequence
gtgtatgacgaggtggatcgaagagaaaatgatgcagtgtggctggctacccaaaaccacagcactctggt

SEQ ID NO: 2578 - DNA, 68 bp, Artificial Sequence
  Amplicon Sequence
gttcactgggggtgtatggggtagatgggtggagagggaggggataagagaggtgcatgttggtattt

SEQ ID NO: 2579 - DNA, 74 bp, Artificial Sequence
  Amplicon Sequence
tgtcatgtacgacggcttctccatgcagcggctggtgaagtgcaacgcctggccttgtcccaacactgtggact

SEQ ID NO: 2580 - DNA, 67 bp, Artificial Sequence
  Amplicon Sequence
gcttatgaccgaccccaagctcatcacctggtctccggtgtgtcgcaacgatgttgcctggaacttt

SEQ ID NO: 2581 - DNA, 75 bp, Artificial Sequence
  Amplicon Sequence
cacacagatctcctactccatccagtcctgaggagccttaggatgcagcatgccttcaggagacactgctggacc

SEQ ID NO: 2582 - DNA, 67 bp, Artificial Sequence
  Amplicon Sequence
cttcgcctttgctgattgcctctccaaacgcctgcctgacgactgccttggagcatgtgcgttatgg

SEQ ID NO: 2583 - DNA, 76 bp, Artificial Sequence
  Amplicon Sequence
tcccactgaagccctttcagttgcggttgaagaaggactcgcttggaggaaaaaaggatgtttacgcctgggcact

SEQ ID NO: 2584 - DNA, 79 bp, Artificial Sequence
  Amplicon Sequence
gtccatcagtgcatgacgtttaaggccacgtatagtcctagctgacgccaataataaaaaacaagaaaccaagtgggct

SEQ ID NO: 2585 - DNA, 67 bp, Artificial Sequence
  Amplicon Sequence
ccatctgcatccatcttgtttgggctccccacccttgagaagtgcctcagataataccctggtggcc

SEQ ID NO: 2586 - DNA, 75 bp, Artificial Sequence
  Amplicon Sequence
gttgggtgcatctctcgggcgtccggcagcggctgtatctcggcatgaattaagaagctaggaagatggagcacg

SEQ ID NO: 2587 - DNA, 73 bp, Artificial Sequence
  Amplicon Sequence
cgaaaagatgctgaacagtgacaaatccaactgaccagaagggaggaggaagctcactggtggctgttcctga

SEQ ID NO: 2588 - DNA, 81 bp, Artificial Sequence
  Amplicon Sequence
ctgggtctcatagaagcaaaggagaacagaaaccaccagccacctcaacccaaggccttgggcaatcagcagccttcgtgg

SEQ ID NO: 2589 - DNA, 73 bp, Artificial Sequence
  Amplicon Sequence
atgctgctggccattccagaggccgtgttttctgacctccatcccttccatgaggaaagcaccaaccagacct

SEQ ID NO: 2590 - DNA, 66 bp, Artificial Sequence
  Amplicon Sequence
gacaaggacggcagcaaggtgacaacagtggtggcaactcctgggcagggtccagacaggccacaa

SEQ ID NO: 2591 - DNA, 66 bp, Artificial Sequence
  Amplicon Sequence
tctccaacttccctctgctgaaggccctgaaaaccagaatcagcaacctgcccacggtgaagaagt

SEQ ID NO: 2592 - DNA, 86 bp, Artificial Sequence
  Amplicon Sequence
aagctatgaggaaaagaagtacacgatgggggacgctcctgattatgacagaagccagtggctgaatgaaaaattcaagctgggcc

SEQ ID NO: 2593 - DNA, 76 bp, Artificial Sequence
  Amplicon Sequence
caatgccatcttgcgctacatcgctcgcaagcacaacatgtgtggtgagactgaagaagaaaagattcgagtggac

SEQ ID NO: 2594 - DNA, 76 bp, Artificial Sequence
  Amplicon Sequence
gagaccctgctgtcccagaaccagggaggcaagaccttcattgtgggagaccagatctccttcgctgactacaacc

SEQ ID NO: 2595 - DNA, 66 bp, Artificial Sequence
  Amplicon Sequence
caccatccccaccctgtcttccacagccgcctgaaagccacaatgagaatgatgcacactgaggcc

SEQ ID NO: 2596 - DNA, 71 bp, Artificial Sequence
  Amplicon Sequence
ccggaaaggccaagacaaaggcggtttcccgctcgcagagagccggcttgcagttcccagtgggccgtatt

SEQ ID NO: 2597 - DNA, 80 bp, Artificial Sequence
  Amplicon Sequence
gactccttcgtccccagttgccgtctaggattgggcctcccataattgctttgccaaaataccagagccttcaagtgcca

SEQ ID NO: 2598 - DNA, 90 bp, Artificial Sequence
  Amplicon Sequence
tgacacccttaccttcctgagaaataccccctgggagcgcggaaagcagagcggacaggtcagtgacttctatttttgactcgtgttttt

SEQ ID NO: 2599 - DNA, 74 bp, Artificial Sequence
  Amplicon Sequence
caagtaccacagcgatgactacattaaattcttgcgctccatccgtccagataacatgtcggagtacagcaagc

SEQ ID NO: 2600 - DNA, 76 bp, Artificial Sequence
  Amplicon Sequence
ggtggctacacaatccgtaatgttgctcgatgttggacatatgagactgcagttgcccttgattgtgagattccca

SEQ ID NO: 2601 - DNA, 66 bp, Artificial Sequence
  Amplicon Sequence
tcctaggcattctggacctctgggttgggatcaggggtaggaatggaaggatggagcatcaacagc

SEQ ID NO: 2602 - DNA, 60 bp, Artificial Sequence
  Amplicon Sequence
agccgtgactgttgaggtcaagtccagcatcgcaggcagcagcacctgggaacgttactt

SEQ ID NO: 2603 - DNA, 84 bp, Artificial Sequence
  Amplicon Sequence
aggctgctggaggtcatctccgtgtgtgattgccccagaggccgtttcttggccgccatctgccaagactgtggccgcaggaag

SEQ ID NO: 2604 - DNA, 70 bp, Artificial Sequence
  Amplicon Sequence
cggtgtgagaagtgcagcaagccctgtgcccgagtgtgctatggtctgggcatggagcacttgcgagagg

SEQ ID NO: 2605 - DNA, 69 bp, Artificial Sequence
  Amplicon Sequence
caccctgtcctatccttcctcagaccctcttgggacctagtctctgccttctactctctacccctggcc

SEQ ID NO: 2606 - DNA, 67 bp, Artificial Sequence
  Amplicon Sequence
ttagggaccctgcagctctggagtgggtggagggagggagctacgggcaggaggaagaattttgtag

SEQ ID NO: 2607 - DNA, 65 bp, Artificial Sequence
  Amplicon Sequence
ccgaaatccagatgatgatgctcatggaccctggtgctacacgggaaatccactcattccttggg

SEQ ID NO: 2608 - DNA, 82 bp, Artificial Sequence
  Amplicon Sequence
tgaacataaagtctgcaacatggaaggtattgcactgcacaggccacattcacgtatatgataccaacagtaaccaacctca

SEQ ID NO: 2609 - DNA, 66 bp, Artificial Sequence
  Amplicon Sequence
tacgcacagaggcaagcagctaagagtccgggatccccagcctactgcctctccagcacttctctc

SEQ ID NO: 2610 - DNA, 73 bp, Artificial Sequence
  Amplicon Sequence
tccatgatggttctgcaggtttctgcggccccccggacagtggctctgacggcgttactgatggtgctgctca

SEQ ID NO: 2611 - DNA, 67 bp, Artificial Sequence
  Amplicon Sequence
gacgatttgccagctttgaggctcaaggtgcattggccaacatagctgtggacaaagccaacctgga

SEQ ID NO: 2612 - DNA, 66 bp, Artificial Sequence
  Amplicon Sequence
gctttctcaggacctggttgctactggttcggcaactgcagaaaatgtcctcccttgtggcttcct

SEQ ID NO: 2613 - DNA, 70 bp, Artificial Sequence
  Amplicon Sequence
cctgcgcggctactacaaccagagcgaggccagttctcacaccctccagtggatgattggctgcgacctg

SEQ ID NO: 2614 - DNA, 71 bp, Artificial Sequence
  Amplicon Sequence
tggcctgtccattggtgatgttgcgaagaaactgggagagatgtggaataacactgctgcagatgacaagc

SEQ ID NO: 2615 - DNA, 74 bp, Artificial Sequence
  Amplicon Sequence
ctacttccagcaaccccagaaagagacatcgggaagattctgatgtggaaatggtggaagatgattcccgaaag

SEQ ID NO: 2616 - DNA, 84 bp, Artificial Sequence
  Amplicon Sequence
caagggagcgaccaactgatcgcacacatgctttgtttggatatggagtgaacacaattatgtaccaaatttaacttggcaaac

SEQ ID NO: 2617 - DNA, 66 bp, Artificial Sequence
  Amplicon Sequence
gccagtaagaacgaggaggatgaaggccattcaaactcctccccacgacactctgaagcagcgacg

SEQ ID NO: 2618 - DNA, 69 bp, Artificial Sequence
  Amplicon Sequence
agtgacagatggacaatgcaagaatgaactccttcctggaataccccatacttagcagtggcgactcgg

SEQ ID NO: 2619 - DNA, 78 bp, Artificial Sequence
  Amplicon Sequence
tcccttgtgttccttctgtgaagaagccctgttctcgttgccctaattcatcttttaatcatgagcctgtttattgcc

SEQ ID NO: 2620 - DNA, 71 bp, Artificial Sequence
  Amplicon Sequence
cgtgccttatggttactttggaggcgggtactactcctgccgagtgtcccggagctcgctgaaaccctgtg

SEQ ID NO: 2621 - DNA, 68 bp, Artificial Sequence
  Amplicon Sequence
cagcctcaagttcggttttcgctaccggagccttcccagaacaaacttcttgtgcgtttgcttccaac

SEQ ID NO: 2622 - DNA, 67 bp, Artificial Sequence
  Amplicon Sequence
ggacgaatacgaccccactatagaggattcctaccggaagcaggtggtcattgatggggagacgtgc

SEQ ID NO: 2623 - DNA, 67 bp, Artificial Sequence
  Amplicon Sequence
ggagatggccgagactgaccccaagaccgtgcaggacctcacctcggtggtgcagacactcctgcag

SEQ ID NO: 2624 - DNA, 78 bp, Artificial Sequence
  Amplicon Sequence
ctggaccgcacggacatccacaccttccaccgcttctaccaatacctcgcccacagcaagcaagtctttcgcgaggcg

SEQ ID NO: 2625 - DNA, 68 bp, Artificial Sequence
  Amplicon Sequence
gctttccaagtggggaattaaagttgcttccatccaacctggaggcttcctaacaaatatcgcaggca

SEQ ID NO: 2626 - DNA, 70 bp, Artificial Sequence
  Amplicon Sequence
ctgctgcgacagtccactacctttttcgagagtgactcccgttgtcccaaggcttcccagagcgaacctg

SEQ ID NO: 2627 - DNA, 63 bp, Artificial Sequence
  Amplicon Sequence
ggtccgcttcgtctttcgagagtgactcccgcggtcccaaggctttccagagcgaacctgtgc

SEQ ID NO: 2628 - DNA, 72 bp, Artificial Sequence
  Amplicon Sequence
ttcagtgtgtccagtgcatctttagtggaggttcacaagtctgaggaaaatgaggagccaatggaaacagat

SEQ ID NO: 2629 - DNA, 84 bp, Artificial Sequence
  Amplicon Sequence
ggctagtagaactggatcccaacaccaaactcttaattagacctaggcctcagctgcactgcccgaaaagcatttgggcagacc

SEQ ID NO: 2630 - DNA, 73 bp, Artificial Sequence
  Amplicon Sequence
cctccctctggtggtgcttcctcagggcccaccattgaagaggttgattaagccaaccaagtgtagatgtagc

SEQ ID NO: 2631 - DNA, 84 bp, Artificial Sequence
  Amplicon Sequence
ccgactggaggagcataaaagcgcagccgagcccagcgccccgcacttttctgagcagacgtccagagcagagtcagccagcat

SEQ ID NO: 2632 - DNA, 71 bp, Artificial Sequence
  Amplicon Sequence
caaaaggcagaggctgataagaacgacaagtctgtgaaggatctggtcatcttgctttatgaaactgcgct

SEQ ID NO: 2633 - DNA, 78 bp, Artificial Sequence
  Amplicon Sequence
gcaagcaacagtagtcgctgttggatcgggttctaaaggaaagggtggagagattcaaccagttagcgtgaaagttgg

SEQ ID NO: 2634 - DNA, 66 bp, Artificial Sequence
  Amplicon Sequence
gagtacgtgtgccgagtgttgggcagctccgtgcctctagaggcctctgtcctggtcaccattgag

SEQ ID NO: 2635 - DNA, 68 bp, Artificial Sequence
  Amplicon Sequence
gcagacagtgaccatctacagctttccggcgcccaacgtgattctgacgaagccagaggtctcagaag

SEQ ID NO: 2636 - DNA, 62 bp, Artificial Sequence
  Amplicon Sequence
ggtcatcctgacactgcaacccactttggtggctgtgggcaagtccttcaccattgagtgca

SEQ ID NO: 2637 - DNA, 70 bp, Artificial Sequence
  Amplicon Sequence
agaaccgcaaggtgagcaaggtggagattctccagcacgtcatcgactacatcagggaccttcagttgga

SEQ ID NO: 2638 - DNA, 76 bp, Artificial Sequence
  Amplicon Sequence
aacgactgctactccaagctcaaggagctggtgcccagcatcccccagaacaagaaggtgagcaagatggaaatcc

SEQ ID NO: 2639 - DNA, 80 bp, Artificial Sequence
  Amplicon Sequence
cttcaccaaatcccttcctggagactaaacctggtgctcaggagcgaaggactgtgaacttgtagcctgaagagccagag

SEQ ID NO: 2640 - DNA, 83 bp, Artificial Sequence
  Amplicon Sequence
tggcctggctcttaatttgcttttgttttgcccagtatagactcggaagtaacagttatagctagtggtcttgcatgattgca

SEQ ID NO: 2641 - DNA, 76 bp, Artificial Sequence
  Amplicon Sequence
tgacaaccaagcaaatgtgaggagtctggtgacctggggcaactttgcctggatgtattaccacatgggcagactg

SEQ ID NO: 2642 - DNA, 76 bp, Artificial Sequence
  Amplicon Sequence
tccggagctgtgatctaaggaggctggagatgtattgcgcacccctcaagcctgccaagtcagctcgctctgtccg

SEQ ID NO: 2643 - DNA, 83 bp, Artificial Sequence
  Amplicon Sequence
gcatggtagccgaagatttcacagtcaaaatcggagattttggtatgacgcgagatatctatgagacagactattaccggaaa

SEQ ID NO: 2644 - DNA, 72 bp, Artificial Sequence
  Amplicon Sequence
ccgtgcttccggacaacttccccagataccccgtgggcaagttcttccaatatgacacctggaagcagtcca

SEQ ID NO: 2645 - DNA, 73 bp, Artificial Sequence
  Amplicon Sequence
gtggacagcaccatgaacatgttgggcgggggaggcagtgctggccggaagcccctcaagtcgggtatgaagg

SEQ ID NO: 2646 - DNA, 68 bp, Artificial Sequence
  Amplicon Sequence
acgcaccgggtgtctgatcccaagttccaccccctccattcaaagataatcatcatcaagaaagggca

SEQ ID NO: 2647 - DNA, 69 bp, Artificial Sequence
  Amplicon Sequence
tggacaagtacgggatgaagctgccaggcatggagtacgttgacggggactttcagtgccacaccttcg

SEQ ID NO: 2648 - DNA, 77 bp, Artificial Sequence
  Amplicon Sequence
tgaaccgcagagaccaacagaggaatccaggcacctctaccacgccctcccagcccaattctgcgggtgtccaagac

SEQ ID NO: 2649 - DNA, 68 bp, Artificial Sequence
  Amplicon Sequence
gggtcactatggagttcaaaggacagaactcctgcctggtgaccgggacaacctggccattcagaccc

SEQ ID NO: 2650 - DNA, 76 bp, Artificial Sequence
  Amplicon Sequence
aaggacgaggagaacacaggcgccgaccgcctcatgacccagcgctgcaaggaccgcctgaactcgctggctatct

SEQ ID NO: 2651 - DNA, 70 bp, Artificial Sequence
  Amplicon Sequence
aaggaaccatctcactgtgtgtaaacatgacttccaagctggccgtggctctcttggcagccttcctgat

SEQ ID NO: 2652 - DNA, 79 bp, Artificial Sequence
  Amplicon Sequence
ggcgctgtcatcgatttcttccctgtgaaaacaagagcaaggccgtggagcaggtgaagaatgcctttaataagctcca

SEQ ID NO: 2653 - DNA, 67 bp, Artificial Sequence
  Amplicon Sequence
agctgaggaagatgctggttccctgcccacagaccttccaggagaatgacctgagcaccttctttcc

SEQ ID NO: 2654 - DNA, 72 bp, Artificial Sequence
  Amplicon Sequence
cctgaaccttccaaagatggctgaaaaagatggatgcttccaatctggattcaatgaggagacttgcctggt

SEQ ID NO: 2655 - DNA, 74 bp, Artificial Sequence
  Amplicon Sequence
ggcctaatgttccagatccttcaaagagtcatattgcccagtggtcacctcacactcctccaaggcacaatttt

SEQ ID NO: 2656 - DNA, 63 bp, Artificial Sequence
  Amplicon Sequence
agccatcactctcagtgcagccaggtcctatcgtggcccctgaggagaccctgactctgcagt

SEQ ID NO: 2657 - DNA, 67 bp, Artificial Sequence
  Amplicon Sequence
gaaagtgtttgcggagcacaagatctcctacagcggccagttcttggtcaaatccggctacgccttc

SEQ ID NO: 2658 - DNA, 81 bp, Artificial Sequence
  Amplicon Sequence
caatctgatcccagggttgaacctcagcgcacttggcatcttttcaacaggactgtccgtgctatctccaccagcagggcc

SEQ ID NO: 2659 - DNA, 72 bp, Artificial Sequence
  Amplicon Sequence
tgtttccaagatcctgctgaaagtgaacgagcctcagataaagcaaagatggattccagccaaccagaaaga

SEQ ID NO: 2660 - DNA, 65 bp, Artificial Sequence
  Amplicon Sequence
cctacagcaagtgcaaggaatacagtgacgacaaagtgcagctggccatgcagacctacgagatg

SEQ ID NO: 2661 - DNA, 78 bp, Artificial Sequence
  Amplicon Sequence
cctcccagtttcatcttccactactgtcatggtggttgtgggctgcacatcccaccaaacctgtcccttccagtccct

SEQ ID NO: 2662 - DNA, 72 bp, Artificial Sequence
  Amplicon Sequence
gtgcccgagccatatagcaggcacgtccgggtcctcactgtccttccactcaacagtcatcaaccactaccg

SEQ ID NO: 2663 - DNA, 72 bp, Artificial Sequence
  Amplicon Sequence
agcctccaggataccagcaaatggatgcggtgacaaatggcagcttagctacaaatgcctgtcagtcggaga

SEQ ID NO: 2664 - DNA, 74 bp, Artificial Sequence
  Amplicon Sequence
ccacagctcaccttctgtcaggtgtccatcccagctccagccagctcccagagaggaagagactggcactgagg

SEQ ID NO: 2665 - DNA, 76 bp, Artificial Sequence
  Amplicon Sequence
ccatgatcctcactctgctggtggactatacactccagacctcgcttagcatggtaaatcaccggctacaaagctt

SEQ ID NO: 2666 - DNA, 66 bp, Artificial Sequence
  Amplicon Sequence
caacgcttcagtgatcaatcccggggcgatttacagatgcaggatcggaaagaatcccggccagac

SEQ ID NO: 2667 - DNA, 75 bp, Artificial Sequence
  Amplicon Sequence
aggccagccctacattatcagagcaagagccggatagaggacaaggctcagatcttgctggactgtggagaagac

SEQ ID NO: 2668 - DNA, 69 bp, Artificial Sequence
  Amplicon Sequence
cagtgacaaacagcccttccaacccaaggaatcccacaaaagatggcgatgacgcccatgaggctaaac

SEQ ID NO: 2669 - DNA, 79 bp, Artificial Sequence
  Amplicon Sequence
gatatgattggtcgctgctttgtgctcagccaggacctggccatccgggatgagttggatggtggggaatggaagttct

SEQ ID NO: 2670 - DNA, 79 bp, Artificial Sequence
  Amplicon Sequence
actcggactgcacaagctatttttgatgacagctatttgggttattctgtggctgtcggagatttcaatggtgatggca

SEQ ID NO: 2671 - DNA, 74 bp, Artificial Sequence
  Amplicon Sequence
tcagaattggatttggctcatttgtggaaaagactgtgatgccttacattagcacaacaccagctaagctcagg

SEQ ID NO: 2672 - DNA, 78 bp, Artificial Sequence
  Amplicon Sequence
accgggagccctacatgaccgaaaatacctgcaaccgttactgccgtgacgagattgagtcagtgaaagagcttaagg

SEQ ID NO: 2673 - DNA, 66 bp, Artificial Sequence
  Amplicon Sequence
caaggtgccctcagtggagctcaccaacctgtacccgtattgcgactatgagatgaaggtgtgcgc

SEQ ID NO: 2674 - DNA, 71 bp, Artificial Sequence
  Amplicon Sequence
tcgtgaaagatgaccaggaggctgtgctatgtttctacaaaaccgccaaggactgcgtcatgatgttcacc

SEQ ID NO: 2675 - DNA, 71 bp, Artificial Sequence
  Amplicon Sequence
gtcaaaatggggagggactagggcagtttggatagctcaacaagatacaatctcactctgtggtggtcctg

SEQ ID NO: 2676 - DNA, 79 bp, Artificial Sequence
  Amplicon Sequence
gagcgcaaagtggaaatcgccttctaccggaaagatgggagctgcttcctatgtctggtggatgtggtgcccgtgaaga

SEQ ID NO: 2677 - DNA, 76 bp, Artificial Sequence
  Amplicon Sequence
tcctgctgctggtcatctacacggctgtcttcacaccctactcggctgccttcctgctgaaggagacggaagaagg

SEQ ID NO: 2678 - DNA, 69 bp, Artificial Sequence
  Amplicon Sequence
cctatcagccgctggtgtggttctggatcctgctcggcctggcttacttcgcctcagtgctcaccacca

SEQ ID NO: 2679 - DNA, 68 bp, Artificial Sequence
  Amplicon Sequence
gaggacgaaggcctctacacctgccaggcatgcagtgttcttggctgtgcaaaagtggaggcattttt

SEQ ID NO: 2680 - DNA, 80 bp, Artificial Sequence
  Amplicon Sequence
cggactttgggtgcgacttgacgagcggtggttcgacaagtggccttgcgggccggatcgtcccagtggaagagttgtaa

SEQ ID NO: 2681 - DNA, 66 bp, Artificial Sequence
  Amplicon Sequence
gtgtcctggtccatgtggtgcacgtgtctccacctccaaggagaggctcctcagtgtgcacctccc

SEQ ID NO: 2682 - DNA, 67 bp, Artificial Sequence
  Amplicon Sequence
ctaaggcacttgctggaagggcagaatgccagtgtgcttgcctatggacccacaggagctgggaaga

SEQ ID NO: 2683 - DNA, 73 bp, Artificial Sequence
  Amplicon Sequence
aattcctgctccaaaagaaagtcttcgaagccgctccactcgcatgtccactgtctcagagcttcgcatcacg

SEQ ID NO: 2684 - DNA, 66 bp, Artificial Sequence
  Amplicon Sequence
ccacagggttgaagaaccagaagccagttcctgctgttcctgtccagaagtctggcacatcaggtg

SEQ ID NO: 2685 - DNA, 79 bp, Artificial Sequence
  Amplicon Sequence
gtccccgggatggatgttttgccaagtcattgttggataagcgagatggtagtacaattgtcagacagcttgactgatc

SEQ ID NO: 2686 - DNA, 74 bp, Artificial Sequence
  Amplicon Sequence
gtgcaaccgcagcttctcgcgctctgaccacctggccctgcatatgaagaggcaccagaactgagcactgcccg

SEQ ID NO: 2687 - DNA, 67 bp, Artificial Sequence
  Amplicon Sequence
cacgagaccggctacttctcggcgctgccgtctctggaggagtactggcaacagacctgcctagagc

SEQ ID NO: 2688 - DNA, 78 bp, Artificial Sequence
  Amplicon Sequence
gcccagaggctccatcgtccatcctcttcctccccagtcggctgaactctccccttgtctgcactgttcaaacctctg

SEQ ID NO: 2689 - DNA, 78 bp, Artificial Sequence
  Amplicon Sequence
gacgtgagggtcctgattctccctggttttaccccagctccatccttgcatcactggggaggacgtgatgagtgagga

SEQ ID NO: 2690 - DNA, 70 bp, Artificial Sequence
  Amplicon Sequence
tgagagccaggcttcttgtatgtctcaaaatgccagccttctgaaagtatacagcaaagaggaccaggat

SEQ ID NO: 2691 - DNA, 71 bp, Artificial Sequence
  Amplicon Sequence
atgtgccagtgagcttgagtccttggagaaacacaagcacctgctagaaagtactgttaaccaggggctca

SEQ ID NO: 2692 - DNA, 72 bp, Artificial Sequence
  Amplicon Sequence
gagaccaaggttgcaaggccaggccctgtgtgaacctttgagctttcatagagagtttcacagcatggactg

SEQ ID NO: 2693 - DNA, 77 bp, Artificial Sequence
  Amplicon Sequence
tgagcggcagaatcaggagtaccagcggctcatggacatcaagtcgcggctggagcaggagattgccacctaccgca

SEQ ID NO: 2694 - DNA, 86 bp, Artificial Sequence
  Amplicon Sequence
ggatgaagcttacatgaacaaggtagagctggagtctcgcctggaagggctgaccgacgagatcaacttcctcaggcagctatatg

SEQ ID NO: 2695 - DNA, 73 bp, Artificial Sequence
  Amplicon Sequence
cagatgaggcacatggagacccaggccaaggacctgaggaatcagttgctcaactaccgttctgccatttcaa

SEQ ID NO: 2696 - DNA, 67 bp, Artificial Sequence
  Amplicon Sequence
actgaccaagcctgagacctactgcacccagtatggcgagtggcagatgaaatgctgcaagtgtgac

SEQ ID NO: 2697 - DNA, 80 bp, Artificial Sequence
  Amplicon Sequence
actcaagcggaaattgaagcagataggtcttatcagcacagtctccgcctcctggattcagtgtctcggcttcagggagt

SEQ ID NO: 2698 - DNA, 68 bp, Artificial Sequence
  Amplicon Sequence
gtgaacgttccggagagcggggagagcgcagaagcgtctctggatggcagccgggagtatgtgaatgt

SEQ ID NO: 2699 - DNA, 80 bp, Artificial Sequence
  Amplicon Sequence
cgctgggcaacattaagagttaccctggattaacgagttacctcgtccgagtggtgagcaccaactacaaccagcatgct

SEQ ID NO: 2700 - DNA, 67 bp, Artificial Sequence
  Amplicon Sequence
cagtgcctctcgcctgtcgactgggacaagcctgacagcagcggcacagagcaggatgacctcttca

SEQ ID NO: 2701 - DNA, 66 bp, Artificial Sequence
  Amplicon Sequence
gatgacggaaagcatccagatggaggcctctacaacaagggaccctcctactcgagttattccggg

SEQ ID NO: 2702 - DNA, 69 bp, Artificial Sequence
  Amplicon Sequence
agcggaaaatggcagacaatttttcgctccatgatgcgttatctgggtctggaaacccaaaccctcaag

SEQ ID NO: 2703 - DNA, 67 bp, Artificial Sequence
  Amplicon Sequence
ttggtgccgttcctatagatgatcctgaagatggaggcaagcactgggtggtgatcgtggcaggttc

SEQ ID NO: 2704 - DNA, 67 bp, Artificial Sequence
  Amplicon Sequence
cacctggtctgggaagatacctggaggttttgattggggtctcggtggccttcgtcctgctgctctt

SEQ ID NO: 2705 - DNA, 66 bp, Artificial Sequence
  Amplicon Sequence
tgcaaacgctggtgtcacagccagccccccaactgacctcatctggaagaaccagaactcgtgggg

SEQ ID NO: 2706 - DNA, 71 bp, Artificial Sequence
  Amplicon Sequence
cccatccagaacactgattgctgtcattcaagtgaaagggatggaggtcagaaagggtgcatagaaagcag

SEQ ID NO: 2707 - DNA, 66 bp, Artificial Sequence
  Amplicon Sequence
ccaatgggagaacaacgggcaggtgttcagcttgctgagcctgggctcacagtaccagcctcagcg

SEQ ID NO: 2708 - DNA, 66 bp, Artificial Sequence
  Amplicon Sequence
tcagcgggctcttaaacaaccagctgtccccgcagtaaagaagcctgcgtggtcaactcctgtctt

SEQ ID NO: 2709 - DNA, 67 bp, Artificial Sequence
  Amplicon Sequence
cgactatgacccactggacaagttcatctactgggtggatgggcgccagaacatcaagcgagccaag

SEQ ID NO: 2710 - DNA, 68 bp, Artificial Sequence
  Amplicon Sequence
ggatgtagccatctctgcctctatagacctcagggccttcgctgtgcttgccctattggctttgaact

SEQ ID NO: 2711 - DNA, 68 bp, Artificial Sequence
  Amplicon Sequence
aatgctgatgacttggagcaggccccacagaccccacagaggatgaagccaccccacagaggatgcag

SEQ ID NO: 2712 - DNA, 74 bp, Artificial Sequence
  Amplicon Sequence
tggttctgattaggtaacgtattggacctgcccacaactcccttgcacgtaaacttcagtgtcccaccttgacc

SEQ ID NO: 2713 - DNA, 67 bp, Artificial Sequence
  Amplicon Sequence
agaagctgtccctgcaagagcaggatgcagcgattgtgaagaacatgaagtctgagctggtacggct

SEQ ID NO: 2714 - DNA, 75 bp, Artificial Sequence
  Amplicon Sequence
ccgggagcagggaatcaccctgcgcgggagcgccgaaatcgtggccgagttcttctcattcggcatcaacagcat

SEQ ID NO: 2715 - DNA, 70 bp, Artificial Sequence
  Amplicon Sequence
gctgcctttggtaagaacatgtcgtccatcttgccattcacgccgccagttgtgaagagactgctgggat

SEQ ID NO: 2716 - DNA, 76 bp, Artificial Sequence
  Amplicon Sequence
ggacattactggcctgttcacaatgagcttgcattccagcctcccatttccaatcatcctgctcctgagtattggt

SEQ ID NO: 2717 - DNA, 72 bp, Artificial Sequence
  Amplicon Sequence
tccatcaaggctttcgactacgagaaggcgtacagcctgcagcggcccaatgaccacgagtttatgcagcag

SEQ ID NO: 2718 - DNA, 67 bp, Artificial Sequence
  Amplicon Sequence
cggaccaccaggtcagagccaattcgcagagcagggaagagtggtacctcaacacccactacccctg

SEQ ID NO: 2719 - DNA, 76 bp, Artificial Sequence
  Amplicon Sequence
gcctttcttacccagaagcagaaggtgggagaactgaaggatgacgactttgagaagatcagtgagctgggggctg

SEQ ID NO: 2720 - DNA, 71 bp, Artificial Sequence
  Amplicon Sequence
ggttggcatcaaaaggaactggtgcaggagagtttcagggacaattactggggacaattgcatttatggca

SEQ ID NO: 2721 - DNA, 76 bp, Artificial Sequence
  Amplicon Sequence
tgagtggaaaagcctgacctatgatgaagtcatcagctttgtgccaccaccccttgaccaagaagagatggagtcc

SEQ ID NO: 2722 - DNA, 77 bp, Artificial Sequence
  Amplicon Sequence
cagatggccactttgagaacattttagctgacaacagtgtgaacgaccagaccaaaatccttgtggttaatgctgcc

SEQ ID NO: 2723 - DNA, 75 bp, Artificial Sequence
  Amplicon Sequence
caaacgggctcatcataatgcactggaacgaaaacgtagggaccacatcaaagacagctttcacagtttgcggga

SEQ ID NO: 2724 - DNA, 75 bp, Artificial Sequence
  Amplicon Sequence
gacttttgcccgctacctttcattccggcgtgacaacaatgagctgttgctcttcatactgaagcagttagtggc

SEQ ID NO: 2725 - DNA, 75 bp, Artificial Sequence
  Amplicon Sequence
ggagaacaatccccttgagacagaatatggcctttctgtctacaaggatcaccagaccatcaccatccaggagat

SEQ ID NO: 2726 - DNA, 82 bp, Artificial Sequence
  Amplicon Sequence
tgatggtcctatgtgtcacattcatcacaggtttcataccaacacaggcttcagcacttcctttggtgtgtttcctgtccca

SEQ ID NO: 2727 - DNA, 71 bp, Artificial Sequence
  Amplicon Sequence
cgctcagccagatgcaatcaatgccccagtcacctgctgttataacttcaccaataggaagatctcagtgc

SEQ ID NO: 2728 - DNA, 66 bp, Artificial Sequence
  Amplicon Sequence
ggagccgactgcaagtacaagtttgagaactggggtgcgtgtgatgggggcacaggcaccaaagtc

SEQ ID NO: 2729 - DNA, 68 bp, Artificial Sequence
  Amplicon Sequence
ctacagggacgccatcgaatccggatcttgatgctggtgtaagtgaacattcaggtgattggttggat

SEQ ID NO: 2730 - DNA, 74 bp, Artificial Sequence
  Amplicon Sequence
ggagtcgaaggtggacaatcttgttgtcaatggcaccggaacaaactcaaccaactccactacagctgttccca

SEQ ID NO: 2731 - DNA, 69 bp, Artificial Sequence
  Amplicon Sequence
gtgaaatgaaacgcaccacactggacagccctttggggaagctggagctgtctggttgtgagcagggtc

SEQ ID NO: 2732 - DNA, 79 bp, Artificial Sequence
  Amplicon Sequence
acggatctaccacaccattgcatatttgacaccccttccccagccaaatagagctttgagtttttttgttggatatgga

SEQ ID NO: 2733 - DNA, 72 bp, Artificial Sequence
  Amplicon Sequence
gggagatcatcgggacaactctccttttgatggacctggaggaaatcttgctcatgcttttcaaccaggccc

SEQ ID NO: 2734 - DNA, 78 bp, Artificial Sequence
  Amplicon Sequence
ccaacgcttgccaaatcctgacaattcagaaccagctctctgtgaccccaatttgagttttgatgctgtcactaccgt

SEQ ID NO: 2735 - DNA, 86 bp, Artificial Sequence
  Amplicon Sequence
ccatgatggagaggcagacatcatgatcaactttggccgctgggagcatggcgatggatacccctttgacggtaaggacggactcc

SEQ ID NO: 2736 - DNA, 79 bp, Artificial Sequence
  Amplicon Sequence
ggatggtagcagtctagggattaacttcctgtatgctgcaactcatgaacttggccattctttgggtatgggacattcc

SEQ ID NO: 2737 - DNA, 67 bp, Artificial Sequence
  Amplicon Sequence
gagaaccaatctcaccgacaggcagctggcagaggaatacctgtaccgctatggttacactcgggtg

SEQ ID NO: 2738 - DNA, 79 bp, Artificial Sequence
  Amplicon Sequence
tcatggtgcccgtcaatgctgtgatggcgatgaagaccaagacgtatcaggtggcccacatgaagagcaaagacaatcg

SEQ ID NO: 2739 - DNA, 65 bp, Artificial Sequence
  Amplicon Sequence
aggggatgacttggacacatctgccattcgacatgactgcaattttgacaaagccatgcagtttt

SEQ ID NO: 2740 - DNA, 91 bp, Artificial Sequence
  Amplicon Sequence
tcatcctggcgatctacttcctctggcagaacctaggtccctctgtcctggctggagtcgctttcatggtcttgctgattccactcaacgg

SEQ ID NO: 2741 - DNA, 66 bp, Artificial Sequence
  Amplicon Sequence
agcgcctggaatctacaactcggagtccagtgttttcccacttgtcatcttctctccaggggctct

SEQ ID NO: 2742 - DNA, 66 bp, Artificial Sequence
  Amplicon Sequence
acttgcaggctgctatccttaacatgctgcccctgagagtaggaatgaccagggttcaagtctgct

SEQ ID NO: 2743 - DNA, 73 bp, Artificial Sequence
  Amplicon Sequence
gatgcagaattgaggcagactttacaagaagatttacttcgtcgattcccagatcttaaccgacttgccaaga

SEQ ID NO: 2744 - DNA, 82 bp, Artificial Sequence
  Amplicon Sequence
tgattaccatcatggctcagattggctcctatgttcctgcagaagaagcgacaattgggattgtggatggcattttcacaag

SEQ ID NO: 2745 - DNA, 68 bp, Artificial Sequence
  Amplicon Sequence
tctattgggggattggtaggaaccgttaccagctggaaattcctgagaatttcaccactcgcaatttg

SEQ ID NO: 2746 - DNA, 72 bp, Artificial Sequence
  Amplicon Sequence
gtgtgagaagtgtgccaaggactgtgtgtgcaaaggcggagaggcagctgaggcagaagcagagaagtgcag

SEQ ID NO: 2747 - DNA, 77 bp, Artificial Sequence
  Amplicon Sequence
ccgccctcacctgaagagaaacgcgctccttggcggacactgggggaggagaggaagaagcgcggctaacttattcc

SEQ ID NO: 2748 - DNA, 71 bp, Artificial Sequence
  Amplicon Sequence
ggccaggatctgtggtggtacaattgactctggccttccgagaaggtaccatcaatgtccacgacgtggag

SEQ ID NO: 2749 - DNA, 66 bp, Artificial Sequence
  Amplicon Sequence
ctatgagccatgtgggaaccggagcttcgagacctgcaggaccatcaacggcatccactccaacat

SEQ ID NO: 2750 - DNA, 67 bp, Artificial Sequence
  Amplicon Sequence
tgcccttgcactgtcctaacggctcagccatcctgcacacctacacccacgtggatgagtgtggctg

SEQ ID NO: 2751 - DNA, 67 bp, Artificial Sequence
  Amplicon Sequence
gtacgaccaagagaaacgggacctaccatggagaagacgggcagaagatgagatggacctggacagg

SEQ ID NO: 2752 - DNA, 75 bp, Artificial Sequence
  Amplicon Sequence
acgagaacgagggcatctatgtgcaggatgtcaagaccggaaaggtgcgcgctgtgattggaagcacctacatgc

SEQ ID NO: 2753 - DNA, 78 bp, Artificial Sequence
  Amplicon Sequence
gaaggaatgggaatcagtcatgagctaatcaccctggagatcagctcccgagatgtcccggatctgactctaatagac

SEQ ID NO: 2754 - DNA, 74 bp, Artificial Sequence
  Amplicon Sequence
agaaactggaggagcaggaccgccgggcactgagcatcaaggagcagctgcagcaggagcatcgtttcctgaag

SEQ ID NO: 2755 - DNA, 74 bp, Artificial Sequence
  Amplicon Sequence
gccgagatcgccaagatgttgccagggaggacagacaatgctgtgaagaatcactggaactctaccatcaaaag

SEQ ID NO: 2756 - DNA, 85 bp, Artificial Sequence
  Amplicon Sequence
cggtacttctcagggctaatatatacgtactctggcctcttctgcgtggtggtcaacccctataaacacctgcccatctactcgg

SEQ ID NO: 2757 - DNA, 73 bp, Artificial Sequence
  Amplicon Sequence
tgacggagcgtgagtgcatcaagtacatgcggcagatctcggagggagtggagtacatccacaagcagggcat

SEQ ID NO: 2758 - DNA, 73 bp, Artificial Sequence
  Amplicon Sequence
taactgacattcttgagcaccagatccgggctgttccctttgagaaccttaacatgcattgtgggcaagccat

SEQ ID NO: 2759 - DNA, 67 bp, Artificial Sequence
  Amplicon Sequence
ctctcccagcacagcttgaacctcactgagtcaaccagcctggacatgttgctggatgacactggtg

SEQ ID NO: 2760 - DNA, 77 bp, Artificial Sequence
  Amplicon Sequence
tagttcccagctgaccatcaaaaaggtggataagaacgacgaggctgagtacatctgcattgctgagaacaaggctg

SEQ ID NO: 2761 - DNA, 69 bp, Artificial Sequence
  Amplicon Sequence
ctactgcggaaagtcggggcactggagtccaaactcgcttcctgccggaacctcgtgtacgatcagtcc

SEQ ID NO: 2762 - DNA, 67 bp, Artificial Sequence
  Amplicon Sequence
agggcaacattccacagctgccctggctgtgatgagtgtccttgcaggggccggagtaggagcactg

SEQ ID NO: 2763 - DNA, 66 bp, Artificial Sequence
  Amplicon Sequence
tatccatcctgatggcgtcatcccagtgctgactttcctcagggatcacaccaatgcacagttcaa

SEQ ID NO: 2764 - DNA, 69 bp, Artificial Sequence
  Amplicon Sequence
tgctggctactgggtgttagtttgcagtcctgtgtgcttccctctcttatgactgtgtccctggttgtc

SEQ ID NO: 2765 - DNA, 79 bp, Artificial Sequence
  Amplicon Sequence
gtgaggcagcgcgactctggcgactggccggccatgccttcccgggctgaggactatgaagtgttgtacaccattggca

SEQ ID NO: 2766 - DNA, 68 bp, Artificial Sequence
  Amplicon Sequence
actccagagctgacctccaccgcccagcctgggaagtcattgtagggagtgagacactgaagccctga

SEQ ID NO: 2767 - DNA, 73 bp, Artificial Sequence
  Amplicon Sequence
cagaccaaggagatggacctcagcgtggtgcggctcatgtttacagcttttcttccggatagcactggcagct

SEQ ID NO: 2768 - DNA, 68 bp, Artificial Sequence
  Amplicon Sequence
ctgccgggatggcttctatgaggctgagctctgcccggaccgctgcatccacagtttccagaacctgg

SEQ ID NO: 2769 - DNA, 78 bp, Artificial Sequence
  Amplicon Sequence
ccaaggaatcatgttcgttcaggaggaggccctggccagcagcctctcgtccactgacagtctgactcccgagcacca

SEQ ID NO: 2770 - DNA, 67 bp, Artificial Sequence
  Amplicon Sequence
gagagagtgagcgaaccctgcccaggctccaagaagcagctgaagtttgaagagctccagtgcgacg

SEQ ID NO: 2771 - DNA, 70 bp, Artificial Sequence
  Amplicon Sequence
ggctgctggtacaaatactgcagaaatgacaccaataataggggcagacacaacagcgtggcttagattg

SEQ ID NO: 2772 - DNA, 83 bp, Artificial Sequence
  Amplicon Sequence
tgatccatctctaggccacatgattgtcaccttagttgcccgggttctcagttttggcaattcttgtgtcaacccatttgctc

SEQ ID NO: 2773 - DNA, 74 bp, Artificial Sequence
  Amplicon Sequence
ccaaccctgcagactccaagcctgggaccatccgtggagacttctgcatacaagttggcaggaacattatacat

SEQ ID NO: 2774 - DNA, 68 bp, Artificial Sequence
  Amplicon Sequence
atctccgcctcgctcatgggcacggtgatggcgaagcgagtgaaggcgacaatcctgtatggctccga

SEQ ID NO: 2775 - DNA, 76 bp, Artificial Sequence
  Amplicon Sequence
cgggtccaccagtttgaatggtcaatgcgagtggctgtcccggctgcagagcggcatggtgccgaaccaatacaac

SEQ ID NO: 2776 - DNA, 75 bp, Artificial Sequence
  Amplicon Sequence
cacttccctgctgggattatatcaacaaccagtgtgatgagctgtgcaacacggtcgagtgcctgtttgacaact

SEQ ID NO: 2777 - DNA, 84 bp, Artificial Sequence
  Amplicon Sequence
aatgttgtccaggttctattgccaagaatgtgttgtccaaaatgcctgtttagtttttaaagatggaactccaccctttgcttg

SEQ ID NO: 2778 - DNA, 69 bp, Artificial Sequence
  Amplicon Sequence
cacagcttgcttgtcgatgtccctgccttcgcctgcctctctgcccttgtcctcatcaccgaccggcat

SEQ ID NO: 2779 - DNA, 83 bp, Artificial Sequence
  Amplicon Sequence
cgagactctcctcatagtgaaaggtatgtgtcagccatgaccaccccggctcgtatgtcacctgtagatttccacacgccaag

SEQ ID NO: 2780 - DNA, 82 bp, Artificial Sequence
  Amplicon Sequence
cagctctctccacgcgattcatcaggatctaccccgagagagccactcatggcggactggggctcagaatggagctgctggg

SEQ ID NO: 2781 - DNA, 76 bp, Artificial Sequence
  Amplicon Sequence
ctacagcctaaacggcaaggactgggaatacattcaggaccccaggacccagcagccaaagctgttcgaagggaac

SEQ ID NO: 2782 - DNA, 69 bp, Artificial Sequence
  Amplicon Sequence
agaaggactatgccgtccagatccacatcctgaaggcggacaaggcgggggactggtggaagttcacgg

SEQ ID NO: 2783 - DNA, 75 bp, Artificial Sequence
  Amplicon Sequence
gcttccacatcgtggtattggagacagtcttctgataggtttcctcggcatcagaagtccttcaaccctgcagtt

SEQ ID NO: 2784 - DNA, 80 bp, Artificial Sequence
  Amplicon Sequence
agagatcaccggcgtaatcaacccagcgttggacaaatactttccgtcagactctggagtgagaatcatagctgagcccg

SEQ ID NO: 2785 - DNA, 80 bp, Artificial Sequence
  Amplicon Sequence
caaccgaagttttcactccagttgtccccacagtagacacatatgatggccgaggtgatagtgtggtttatggactgagg

SEQ ID NO: 2786 - DNA, 66 bp, Artificial Sequence
  Amplicon Sequence
tccttgaccataccggagggtgcatgtacatctccggtgtccctgggacagggaagactgccactg

SEQ ID NO: 2787 - DNA, 68 bp, Artificial Sequence
  Amplicon Sequence
gtttctgaaggggaggtcacagcctgagctggcctcctatgcctcatcatgtcccaaaccagacacct

SEQ ID NO: 2788 - DNA, 77 bp, Artificial Sequence
  Amplicon Sequence
gctcatcatggtcatgtgctacttgaaaagtcagtggatcaaggagacctgttatcctgacatccctgacccttaca

SEQ ID NO: 2789 - DNA, 72 bp, Artificial Sequence
  Amplicon Sequence
ccctcgtgctgatgctactgaggagccagcgtctagggcagcagccgcttcctagaagaccaggtcatgatg

SEQ ID NO: 2790 - DNA, 76 bp, Artificial Sequence
  Amplicon Sequence
gcggaaggtccctcagacatccccgattgaaagaaccagagaggctctgagaaacctcgggaaacttagatcatca

SEQ ID NO: 2791 - DNA, 65 bp, Artificial Sequence
  Amplicon Sequence
tggagactctcagggtcgaaaacggcggcagaccagcatgacagatttctaccactccaaacgcc

SEQ ID NO: 2792 - DNA, 66 bp, Artificial Sequence
  Amplicon Sequence
cggtggaccacgaagagttaacccgggacttggagaagcactgcagagacatggaagaggcgagcc

SEQ ID NO: 2793 - DNA, 68 bp, Artificial Sequence
  Amplicon Sequence
ctttgaacccttgcttgcaataggtgtgcgtcagaagcacccaggacttccatttgctttgtcccggg

SEQ ID NO: 2794 - DNA, 77 bp, Artificial Sequence
  Amplicon Sequence
cccagctagtgttcctcagaacaaagattggaaaaagctggccgagaaccatttatacatagaggaagggcttacgg

SEQ ID NO: 2795 - DNA, 71 bp, Artificial Sequence
  Amplicon Sequence
agcagtggcttgctttcttctcctgtgatgtcccagtttcccactctgaagatcccaacatggtcctagca

SEQ ID NO: 2796 - DNA, 81 bp, Artificial Sequence
  Amplicon Sequence
ccgcaacgtggttttctcaccctatggggtggcctcggtgttggccatgctccagctgacaacaggaggagaaacccagca

SEQ ID NO: 2797 - DNA, 70 bp, Artificial Sequence
  Amplicon Sequence
gagctgtgggttgttatggaatacttggctggaggctccttgacagatgtggtgacagaaacttgcatgg

SEQ ID NO: 2798 - DNA, 65 bp, Artificial Sequence
  Amplicon Sequence
ggagctgacctgcttcctacatcgcctggcctcgatgcataaggactatgctgtggtgctctgct

SEQ ID NO: 2799 - DNA, 69 bp, Artificial Sequence
  Amplicon Sequence
aggtggctgtgttactgcaacgtgccacagttctgcgacagtctacctcggtacgaaaccacacaggtg

SEQ ID NO: 2800 - DNA, 71 bp, Artificial Sequence
  Amplicon Sequence
gaaggtgttggaggcactcaaggacctcatcaacgaggcctgctgggatattagctccagcggtgtaaacc

SEQ ID NO: 2801 - DNA, 67 bp, Artificial Sequence
  Amplicon Sequence
ttgttggtgtgccctggtgccgtggtggcggtcactccctctgctgccagtgtttggacagaaccca

SEQ ID NO: 2802 - DNA, 62 bp, Artificial Sequence
  Amplicon Sequence
actgaaggagacccttggagcctaggggcatcggcaggagagtgtgtgggcagggttattta

SEQ ID NO: 2803 - DNA, 79 bp, Artificial Sequence
  Amplicon Sequence
agttactaaaaaataccacgaggtccttcagttgagaccaaagaccggtgtcaggggattgcacaaatcactcaccgac

SEQ ID NO: 2804 - DNA, 74 bp, Artificial Sequence
  Amplicon Sequence
tatcgaggcaggtcataccatgaccggaagtcaaaagttgacctggataggctcaatgatgatgccaagcgtta

SEQ ID NO: 2805 - DNA, 72 bp, Artificial Sequence
  Amplicon Sequence
gggagtttccaagagatggactagtgcttggtcgggtcttggggtctggagcgtttgggaaggtggttgaag

SEQ ID NO: 2806 - DNA, 66 bp, Artificial Sequence
  Amplicon Sequence
ccagctctccttccagctacagatcaatgtccctgtccgagtgctggagctaagtgagagccaccc

SEQ ID NO: 2807 - DNA, 68 bp, Artificial Sequence
  Amplicon Sequence
ggaaaacgttcgtcaacatcacgccagctgaggtgggtgtcctggttggcaaagaccggtcaagtttt

SEQ ID NO: 2808 - DNA, 82 bp, Artificial Sequence
  Amplicon Sequence
tctatacgtcgatggtgactgcacaatggacatccggacaaagagtcaaggtggggagccaacatacaatgtggctgtcggc

SEQ ID NO: 2809 - DNA, 74 bp, Artificial Sequence
  Amplicon Sequence
agagccagttgctgtagaactcaaatctctgctgggcaaggatgttctgttcttgaaggactgtgtaggcccag

SEQ ID NO: 2810 - DNA, 98 bp, Artificial Sequence
  Amplicon Sequence
tgctacctggacagcccgttggtgcgcttcctcctgaaacgagctgtgtctgacttgagagtgactcactacttcttctggttactgaaggacggcct

SEQ ID NO: 2811 - DNA, 83 bp, Artificial Sequence
  Amplicon Sequence
ataccaatcaccgcacaaacccaggctatttgttaagtccagtcacagcgcaaagaaacatatgcggagaaaatgctagtgtg

SEQ ID NO: 2812 - DNA, 67 bp, Artificial Sequence
  Amplicon Sequence
gtgattgaagagcatgccaattggtctgtatcccgagaagcaggatttagctattcccacgcaggac

SEQ ID NO: 2813 - DNA, 67 bp, Artificial Sequence
  Amplicon Sequence
ctgctcaaggacaccgtctacacggacttcgatgggacccgagtgtatagccctccagagtggatcc

SEQ ID NO: 2814 - DNA, 68 bp, Artificial Sequence
  Amplicon Sequence
gatcaacggctacatccagaagatcaagtcgggagaggaggactttgagtctctggcctcacagttca

SEQ ID NO: 2815 - DNA, 68 bp, Artificial Sequence
  Amplicon Sequence
cagcaccagcgattacgacgttggctgggagagtcctcacaatggctcggggacgtgggcctattcag

SEQ ID NO: 2816 - DNA, 68 bp, Artificial Sequence
  Amplicon Sequence
ccgcctggacattgattcaccacccatcacagcccggaacactggcatcatctgtaccattggcccag

SEQ ID NO: 2817 - DNA, 79 bp, Artificial Sequence
  Amplicon Sequence
gcatccctcacccatcctagaggccaggcaggagcccttctatacccacccagaatgagacatccagcagatttccagc

SEQ ID NO: 2818 - DNA, 76 bp, Artificial Sequence
  Amplicon Sequence
cccatggatgctcctctgaagagactttcctcattgactgccgaggccccatgaatcaatgtctggtagccaccgg

SEQ ID NO: 2819 - DNA, 69 bp, Artificial Sequence
  Amplicon Sequence
aatgaatacagtattcccaagcacatcaaccccgtggccgcctccctcatccagaagatgcttcagaca

SEQ ID NO: 2820 - DNA, 66 bp, Artificial Sequence
  Amplicon Sequence
tgaaggagacgtaccgctgcatcaagcaggttcactacacgctgcctgccagcctctcactgcctg

SEQ ID NO: 2821 - DNA, 84 bp, Artificial Sequence
  Amplicon Sequence
cagggaggtggttgcaaatttctaaggtacaattgctctattgagtcaccacgaaaaggctggagcttcatgcatcctgggaga

SEQ ID NO: 2822 - DNA, 77 bp, Artificial Sequence
  Amplicon Sequence
cttacggttttcgtggagaagccttggggtcaatttgttgtatagctgaggttttaattacaacaagaacggctgct

SEQ ID NO: 2823 - DNA, 75 bp, Artificial Sequence
  Amplicon Sequence
gatgtggactgccattcaaaccaggaagataccggatgtaaatttcgagttttgcctcagccaactaatctcgca

SEQ ID NO: 2824 - DNA, 72 bp, Artificial Sequence
  Amplicon Sequence
tgactttatggagcccaagtttgagtttgctgtgaagttcaatgcactggaattagatgacagcgacttggc

SEQ ID NO: 2825 - DNA, 71 bp, Artificial Sequence
  Amplicon Sequence
tcctcatttggatgggaaacatgtggtgtttggccaagtaattaaaggaataggagtggcaaggatattgg

SEQ ID NO: 2826 - DNA, 62 bp, Artificial Sequence
  Amplicon Sequence
gccatccgcaaaggctttctcgcttgtcaccttgccatgtggaagaaactggcggaatggcc

SEQ ID NO: 2827 - DNA, 74 bp, Artificial Sequence
  Amplicon Sequence
ggctcagagcataaggcttcagggcccaagttgggagaagtgaccaaagtgtagccagttttctgagttcccgt

SEQ ID NO: 2828 - DNA, 85 bp, Artificial Sequence
  Amplicon Sequence
gcatcaggctgtcattatggtgtccttacctgtgggagctgtaaggtcttctttaagagggcaatggaagggcagcacaactact

SEQ ID NO: 2829 - DNA, 69 bp, Artificial Sequence
  Amplicon Sequence
ggtgtccttcgccagatcactgttaatgatttgcctgtgggacgctccgtggatgaggctctgcggctg

SEQ ID NO: 2830 - DNA, 80 bp, Artificial Sequence
  Amplicon Sequence
tgaccccaatggagtcatcaagcatttgagcgtcaacgatctcccagtgggccgaagcgtggaagaaaccctccgcttgg

SEQ ID NO: 2831 - DNA, 75 bp, Artificial Sequence
  Amplicon Sequence
ttacccatttggcctggattaatacccctcgaagacaaggaggacttgggccaataaggattccacttctttcag

SEQ ID NO: 2832 - DNA, 76 bp, Artificial Sequence
  Amplicon Sequence
ctgtgagccagaggatgtcagctgccaattgtgttttcctgcagcaattccataaacacatcctggtgtcatcaca

SEQ ID NO: 2833 - DNA, 70 bp, Artificial Sequence
  Amplicon Sequence
caagcaatgcgtcatcaatgtccccagcctctgcggaatggatcacactgagaagagggggcggatttac

SEQ ID NO: 2834 - DNA, 67 bp, Artificial Sequence
  Amplicon Sequence
gacccagctccactcctgcttccagaccatggaccgcctgtactttgtgatggagtacgtgaatggg

SEQ ID NO: 2835 - DNA, 68 bp, Artificial Sequence
  Amplicon Sequence
ctgacacttgccgcagagaatccctttctcacccacctcatctgcaccttccagaccaaggaccacct

SEQ ID NO: 2836 - DNA, 84 bp, Artificial Sequence
  Amplicon Sequence
gcgatacatgagcccagaacagatttcttcgcaagactatggaaaggaagtggacctctacgctttggggctaattcttgctga

SEQ ID NO: 2837 - DNA, 86 bp, Artificial Sequence
  Amplicon Sequence
gccctcccagtgtgcaaataagggctgctgtttcgacgacaccgttcgtggggtcccctggtgcttctatcctaataccatcgacg

SEQ ID NO: 2838 - DNA, 66 bp, Artificial Sequence
  Amplicon Sequence
ccacgacaaagccgactacatgcctgaaacaaggctgagaatcccggcagcagagcccatcgagta

SEQ ID NO: 2839 - DNA, 81 bp, Artificial Sequence
  Amplicon Sequence
tggctaagtgaagatgacaatcatgttgcagcaattcactgtaaagctggaaagggacgaactggtgtaatgatatgtgca

SEQ ID NO: 2840 - DNA, 78 bp, Artificial Sequence
  Amplicon Sequence
taactggggcaaccttttcttcgcctctgcctttgccttcctggggctcttggcgctgacagtcaccttttcctgcaa

SEQ ID NO: 2841 - DNA, 83 bp, Artificial Sequence
  Amplicon Sequence
agtgactgggagtgggctagaaggggaccacctgtctgacacctccacaacgtcgctggagctcgattcacggtaacaggctt

SEQ ID NO: 2842 - DNA, 73 bp, Artificial Sequence
  Amplicon Sequence
cgaggtacaagctgagatcaagaaatcttggagccgctggacactggcactggacttcaagcgaaaggcacgc

SEQ ID NO: 2843 - DNA, 68 bp, Artificial Sequence
  Amplicon Sequence
gaccggtcgaatgataaggtgtacgagaatgtgacgggcctggtgaaagctgtcatcgagatgtccag

SEQ ID NO: 2844 - DNA, 74 bp, Artificial Sequence
  Amplicon Sequence
caagcccagccgacctaagtacagaccccctccgcaaaccaacctcctggctccaaagctgcagttccaggttc

SEQ ID NO: 2845 - DNA, 70 bp, Artificial Sequence
  Amplicon Sequence
aatatttgtgcggggtatgggggtgggtttttaaatctcgtttctcttggacaagcacagggatctcgtt

SEQ ID NO: 2846 - DNA, 68 bp, Artificial Sequence
  Amplicon Sequence
cctgttctcggcaccttaaattattagaccccggggcagtcaggtgctccggacacccgaaggcaata

SEQ ID NO: 2847 - DNA, 81 bp, Artificial Sequence
  Amplicon Sequence
cgcttgcctaactcatactttcccgttgacacttgatccacgcagcgtggcactgggacgtaagtggcgcagtctgaatgg

SEQ ID NO: 2848 - DNA, 74 bp, Artificial Sequence
  Amplicon Sequence
aatgaggaagtttcggatggggctgatccagacagccgaccagctgcgcttctcctacctggctgtgatcgaag

SEQ ID NO: 2849 - DNA, 78 bp, Artificial Sequence
  Amplicon Sequence
tgttttagctgagggacgtggtgccgacgtccccaaacctagctaggctaagtcaagatcaacattccagggttggta

SEQ ID NO: 2850 - DNA, 75 bp, Artificial Sequence
  Amplicon Sequence
aacttccggtacctcgttcgtgactacatgaagcagagtcctcccgaatcgccgattctggtgcattgcagtgct

SEQ ID NO: 2851 - DNA, 66 bp, Artificial Sequence
  Amplicon Sequence
catggcctgatcatggtgtgcccacagcaaatgctgcagaaagtatcctgcagtttgtacacatgg

SEQ ID NO: 2852 - DNA, 74 bp, Artificial Sequence
  Amplicon Sequence
ggctactctgatctatgttgataaggaaaatggagaaccaggcacccgtgtggttgctaaggatgggctgaagc

SEQ ID NO: 2853 - DNA, 79 bp, Artificial Sequence
  Amplicon Sequence
cctgcagctgtgggacatcgcggggcaggagcgatttggcaacatgacccgagtatactacaaggaagctgttggtgct

SEQ ID NO: 2854 - DNA, 78 bp, Artificial Sequence
  Amplicon Sequence
gcgacagctcctctagttccaccatgtccgcgggcggagacttcgggaatccgctgaggaaattcaagctggtgttcc

SEQ ID NO: 2855 - DNA, 66 bp, Artificial Sequence
  Amplicon Sequence
tgttgtaaatgtctcagcccctcgttcttggtcctgtcccttggaacctttgtacgctttgctcaa

SEQ ID NO: 2856 - DNA, 78 bp, Artificial Sequence
  Amplicon Sequence
gaacttcttgagcaggagcatacccagggcttcataatcaccttctgttcagcactagatgatattcttgggggtgga

SEQ ID NO: 2857 - DNA, 67 bp, Artificial Sequence
  Amplicon Sequence
agctagcctcagtgacacacatgacaggttgcactgccgacgttgtgtcaacagccgtcagatccgg

SEQ ID NO: 2858 - DNA, 73 bp, Artificial Sequence
  Amplicon Sequence
cgtcgtatgcgagagtctgtttccaggatgcctgttagttctcagcacagatattctacacctcacgccttca

SEQ ID NO: 2859 - DNA, 84 bp, Artificial Sequence
  Amplicon Sequence
ggtgtcagatataaatgtgcaaatgccttcttgctgtcctgtcggtctcagtacgttcactttatagctgctggcaatatcgaa

SEQ ID NO: 2860 - DNA, 73 bp, Artificial Sequence
  Amplicon Sequence
tccttcagctttcacactgggctcagaaatgaagttgcatgactcttctggaagtcaggtgggaacaggattt

SEQ ID NO: 2861 - DNA, 81 bp, Artificial Sequence
  Amplicon Sequence
aacatgattatccaagccgctggactgccattgtggacaaaattggcttttatcttcagtccgataacagtgcttgttggc

SEQ ID NO: 2862 - DNA, 79 bp, Artificial Sequence
  Amplicon Sequence
caagtcagttgagacgccagttgtgtggaggaagtcaggccgccatagaaagaatgatccactttggacgagagctgca

SEQ ID NO: 2863 - DNA, 67 bp, Artificial Sequence
  Amplicon Sequence
tgtggatgctggattgatttcaccactggtgcagctgctaaatagcaaagaccaggaagtgctgctt

SEQ ID NO: 2864 - DNA, 80 bp, Artificial Sequence
  Amplicon Sequence
agtctgtgagaaacgaccgaaacaagaagaagaaggaggtgcccaagcccgagtgctctgagagctacacgctgacgccg

SEQ ID NO: 2865 - DNA, 78 bp, Artificial Sequence
  Amplicon Sequence
tgcctggacatcctgattcttagaatttgcaccaggtataccccagaacaagacaccatgactttctcagacggcctt

SEQ ID NO: 2866 - DNA, 69 bp, Artificial Sequence
  Amplicon Sequence
agtgggagacacctgacctttctcaagctgagattgagcagaagatcaaggagtacaatgcccagatca

SEQ ID NO: 2867 - DNA, 69 bp, Artificial Sequence
  Amplicon Sequence
cgagagggagagcaagaccatcatgctgcgcggccttcccatcaccatcacagagagcgatattcgaga

SEQ ID NO: 2868 - DNA, 79 bp, Artificial Sequence
  Amplicon Sequence
ggaaccacattatggatctttgcatagaatgtcaagctaaccaggcgtccgctacttcagaagagtgtactgtcgcatg

SEQ ID NO: 2869 - DNA, 66 bp, Artificial Sequence
  Amplicon Sequence
gggctgggtgagaatgtgatggagaggaagaagccggccctggtatccattccggaggatgttgtg

SEQ ID NO: 2870 - DNA, 83 bp, Artificial Sequence
  Amplicon Sequence
tgctaactcctgcacagccccgtcctcttcctttctgctagcctggctaaatctgctcattatttcagaggggaaacctagca

SEQ ID NO: 2871 - DNA, 96 bp, Artificial Sequence
  Amplicon Sequence
tcaagaccatcatcactttcattgtctcggacgtgcggggcctgggcctcccggtccgcaagcagttccagttatactccgtgtacttcctgatcc

SEQ ID NO: 2872 - DNA, 67 bp, Artificial Sequence
  Amplicon Sequence
aagcatgaacaggacttgaccatctttccaacccctggggaagacatttgcaactgacttggggagg

SEQ ID NO: 2873 - DNA, 68 bp, Artificial Sequence
  Amplicon Sequence
cccgttcggtctgaggaaggccgggacatggcgaaccggatcagtgcctttggctaccttgagtgctc

SEQ ID NO: 2874 - DNA, 74 bp, Artificial Sequence
  Amplicon Sequence
ccagacgagcgattagaagcggcagcttgtgaggtgaatgatttgggggaagaggaggaggaggaagaggagga

SEQ ID NO: 2875 - DNA, 79 bp, Artificial Sequence
  Amplicon Sequence
accctggaagagatggatcagaaaaaaagatccgggagtgtgtgatctgtatgatggactttgtttatggggacccaat

SEQ ID NO: 2876 - DNA, 73 bp, Artificial Sequence
  Amplicon Sequence
tgtgcacataggaatgagcttcagatgcagttggccagcaaagagagtgatattgagcaattgcgtgctaaac

SEQ ID NO: 2877 - DNA, 66 bp, Artificial Sequence
  Amplicon Sequence
gatccgagaccctcgctcccccatcaacgtggagagcttgctggatggcttaaattccttggtcct

SEQ ID NO: 2878 - DNA, 75 bp, Artificial Sequence
  Amplicon Sequence
ccattctatcatcaacgggtacaaacgagtcctggccttgtctgtggagacggattacaccttcccacttgctga

SEQ ID NO: 2879 - DNA, 73 bp, Artificial Sequence
  Amplicon Sequence
cagtcggctttaccctatcgacgcagcgtccccacttggttgaagttgacatctgacgacgtgaaggagcaga

SEQ ID NO: 2880 - DNA, 66 bp, Artificial Sequence
  Amplicon Sequence
gggctactggcagctacattgctgggactaatggcaattccaatggccttgtaccgatgctgagag

SEQ ID NO: 2881 - DNA, 71 bp, Artificial Sequence
  Amplicon Sequence
cagcgggattaaacagtcctttaaccagcacagccagttaaaagatgcagcctcactgcttcaacgcagat

SEQ ID NO: 2882 - DNA, 74 bp, Artificial Sequence
  Amplicon Sequence
gactggagtggtgtttggtgccagcctattcctgctgctttcattgacagtattcagcattgtgagcgtaacag

SEQ ID NO: 2883 - DNA, 69 bp, Artificial Sequence
  Amplicon Sequence
aacagagacattgccaaccatattggatctgcttgctgtccaaaccagcaaacttcctgggcaaatcac

SEQ ID NO: 2884 - DNA, 66 bp, Artificial Sequence
  Amplicon Sequence
gctctgttgtgtcctgttgccggctctggccttcctgtgactgactgtgaagtggcttctccgtac

SEQ ID NO: 2885 - DNA, 70 bp, Artificial Sequence
  Amplicon Sequence
tggacaaggtgatgaaggagctagacgagaatggagacggggaggtggacttccaggagtatgtggtgct

SEQ ID NO: 2886 - DNA, 73 bp, Artificial Sequence
  Amplicon Sequence
tggctgtgctggtcactaccttccacaagtactcctgccaagagggcgacaagttcaagctgagtaaggggga

SEQ ID NO: 2887 - DNA, 70 bp, Artificial Sequence
  Amplicon Sequence
gactgctgtcatggcgtgccctctggagaaggccctggatgtgatggtgtccaccttccacaagtactcg

SEQ ID NO: 2888 - DNA, 76 bp, Artificial Sequence
  Amplicon Sequence
actccctgataaaggggaatttccatgccgtctacagggatgacctgaagaaattgctagagaccgagtgtcctca

SEQ ID NO: 2889 - DNA, 65 bp, Artificial Sequence
  Amplicon Sequence
ctttgggacagagtgcaagacgatgacttgcaaaatgtcgcagctggaacgcaacatagagacca

SEQ ID NO: 2890 - DNA, 67 bp, Artificial Sequence
  Amplicon Sequence
agacaaggatgccgtggataaattgctcaaggacctggacgccaatggagatgcccaggtggacttc

SEQ ID NO: 2891 - DNA, 67 bp, Artificial Sequence
  Amplicon Sequence
ccttttaccactgcctggttgcagaagtgccgaaagagcactggactccggaaggacacagcattgt

SEQ ID NO: 2892 - DNA, 67 bp, Artificial Sequence
  Amplicon Sequence
ggactcaacgatgggcagatcaagatctgggaggtgcagacagggctcctgcttttgaatctttccg

SEQ ID NO: 2893 - DNA, 76 bp, Artificial Sequence
  Amplicon Sequence
gaaattgacgaggggtgtcttgggcagagctggctctgagcgcctccatccaaggccaggttctccgttagctcct

SEQ ID NO: 2894 - DNA, 71 bp, Artificial Sequence
  Amplicon Sequence
gctccaggatgtgtttctgttgtcctcgcgggaccaccggaccccgctgctctatgccgtcttctccacgt

SEQ ID NO: 2895 - DNA, 86 bp, Artificial Sequence
  Amplicon Sequence
cgcgagcccctcattatacactgggcagcctccccacagcgcatcgaggaatgcgtgctctcaggcaaggatgtcaacggcgagtg

SEQ ID NO: 2896 - DNA, 63 bp, Artificial Sequence
  Amplicon Sequence
ttccagcccaacacagtgaacactttggcctgcccgctcctctccaacctggcgacccgactc

SEQ ID NO: 2897 - DNA, 66 bp, Artificial Sequence
  Amplicon Sequence
caagctgaacggtgtgtccgaaagggacctgaagaaatcggtgctgtggctcaaagacagcttgca

SEQ ID NO: 2898 - DNA, 67 bp, Artificial Sequence
  Amplicon Sequence
tacaggatgaggctgggcattgcctgggacagcctatgtaaggccatgtgccccttgccctaacaac

SEQ ID NO: 2899 - DNA, 77 bp, Artificial Sequence
  Amplicon Sequence
cagtggagaccagttgggtagtggtgactgggtacgctacaagctctgcatgtgtgctgatgggacgctcttcaagg

SEQ ID NO: 2900 - DNA, 71 bp, Artificial Sequence
  Amplicon Sequence
ccaacaccttcttggcttctgggacctgtgttcttgctgagcaccctctccggtttgggttgggataacag

SEQ ID NO: 2901 - DNA, 70 bp, Artificial Sequence
  Amplicon Sequence
gtccaaggcacatatccactgctcggtgaaagcagagaactcggtggcggccaaatcgggaggctgcttc

SEQ ID NO: 2902 - DNA, 77 bp, Artificial Sequence
  Amplicon Sequence
aacggactccctcaatttgtgcaagatttgcatgaccatggacagaaatatgtcatcatcttggaccctgcaatttc

SEQ ID NO: 2903 - DNA, 67 bp, Artificial Sequence
  Amplicon Sequence
ttggcattggaactacattcaatccgcggtatcctcggattagttctaggacccccttctccatacc

SEQ ID NO: 2904 - DNA, 65 bp, Artificial Sequence
  Amplicon Sequence
aaccacagttggaggaggacggcagagacagtttccctccccgctataccaacacccttccttcg

SEQ ID NO: 2905 - DNA, 70 bp, Artificial Sequence
  Amplicon Sequence
tccagcccaaatcctcctggtggcacatcctaccccagatgctaaagtgattcaaggactccaggacacc

SEQ ID NO: 2906 - DNA, 66 bp, Artificial Sequence
  Amplicon Sequence
gatggtaggaagggatgtgcccgcctctccacgcactcagctatacctcattcacagctccttgtg

SEQ ID NO: 2907 - DNA, 74 bp, Artificial Sequence
  Amplicon Sequence
ccagagtcatgctcatccagccccaccagttgcaccagtgcagggacagcagcaatttcagaggctgaaggtgg

SEQ ID NO: 2908 - DNA, 72 bp, Artificial Sequence
  Amplicon Sequence
agctggggtgtctgtttcatgtggaatacctgacttcaggtcaagggatggtatttatgctcgccttgctgt

SEQ ID NO: 2909 - DNA, 76 bp, Artificial Sequence
  Amplicon Sequence
ccattgcctttgctttgttcataatttcagcagggcagaataaaaaccatgggaggcaaagaaaggaaatccggaa

SEQ ID NO: 2910 - DNA, 71 bp, Artificial Sequence
  Amplicon Sequence
agttgcagaatctaagcctggaaggcctgcggctttcggatcccattgtcaatactctcgcaaaaaactca

SEQ ID NO: 2911 - DNA, 64 bp, Artificial Sequence
  Amplicon Sequence
tctgccagtgctgaattctttgctgacattgccctggctcctatggaagctgctaaggttcgaa

SEQ ID NO: 2912 - DNA, 67 bp, Artificial Sequence
  Amplicon Sequence
gcctgagtctcctgtgcccacatcccaggcttcaccctgaatggttccatgcctgagggtggagact

SEQ ID NO: 2913 - DNA, 66 bp, Artificial Sequence
  Amplicon Sequence
ccgttcgaagagtcgtgagggggtgacgggttaagattcggagagagaggtgctagtggctggact

SEQ ID NO: 2914 - DNA, 75 bp, Artificial Sequence
  Amplicon Sequence
cctgctttcaaccacattgaattgaactcagatcagagtggcaagagcaatgggactcgtttgtgaagctgctct

SEQ ID NO: 2915 - DNA, 70 bp, Artificial Sequence
  Amplicon Sequence
gcgcagaggccagttaaagtagatcacctcctcgaacccactccggttccccgcaacccacagctcagct

SEQ ID NO: 2916 - DNA, 74 bp, Artificial Sequence
  Amplicon Sequence
atggccaatgtttgatgcttaacccccccaatttctgtgagatggatggccagtgcaagcgtgacttgaagtgt

SEQ ID NO: 2917 - DNA, 66 bp, Artificial Sequence
  Amplicon Sequence
agggactgtcctggcacattatgcagatgtcctgggtcttttgcttagactgcggcaaatttgttg

SEQ ID NO: 2918 - DNA, 69 bp, Artificial Sequence
  Amplicon Sequence
cccaatcggaagcctaactacagcgagctgcaggactctaatccagagtttaccttccagcagccctac

SEQ ID NO: 2919 - DNA, 76 bp, Artificial Sequence
  Amplicon Sequence
ggctggccaaacataagcagctgcactgcgatgcccagtctagaaaatctttcagctgtaaatactgtgacaagga

SEQ ID NO: 2920 - DNA, 79 bp, Artificial Sequence
  Amplicon Sequence
ggctggtcggcagagagtagcctgcaacattcggccgtggtttacatgagtttacccctcaatcccaaacctttcctca

SEQ ID NO: 2921 - DNA, 70 bp, Artificial Sequence
  Amplicon Sequence
tgaagagaggcatgttggagacttgggcaatgtgactgctgacaaagatggtgtggccgatgtgtctatt

SEQ ID NO: 2922 - DNA, 78 bp, Artificial Sequence
  Amplicon Sequence
gcttgtccaaatcaggatccactgcaaggaacaacaggccttattccactgctggggattgatgtgtgggagcacgct

SEQ ID NO: 2923 - DNA, 65 bp, Artificial Sequence
  Amplicon Sequence
tctgcaccaaattctccaagaacaccgttaacacctccgcctgcttctggtgcttccagtaccac

SEQ ID NO: 2924 - DNA, 67 bp, Artificial Sequence
  Amplicon Sequence
tcgtgtgcaagcctgagatgggcctcccctaccaggggcatgactccggtgtgaatctccccgacag

SEQ ID NO: 2925 - DNA, 73 bp, Artificial Sequence
  Amplicon Sequence
tcttccctgtacactggcagttcggccagctggaccagcaccccattgacgggtacctctcccacaccgagct

SEQ ID NO: 2926 - DNA, 68 bp, Artificial Sequence
  Amplicon Sequence
aggaatgcagcggattcctctgtcccaagtgctcccagaaggcaggattctgaagaccactccagcga

SEQ ID NO: 2927 - DNA, 77 bp, Artificial Sequence
  Amplicon Sequence
cagaccagtccctggtcataggtctgaaagggcaatccggacccagcccaagcaactgattgtggatgacttgaagg

SEQ ID NO: 2928 - DNA, 66 bp, Artificial Sequence
  Amplicon Sequence
tgtggcaagtgcaaatgtaaggagtgcacctacccaaggcctctgccatcagactggatctgcgac

SEQ ID NO: 2929 - DNA, 79 bp, Artificial Sequence
  Amplicon Sequence
agatggaagaagccaacctggcgagccgagcgaaggcccaggagctgatccaggccaccaaccagatcctcagccacag

SEQ ID NO: 2930 - DNA, 63 bp, Artificial Sequence
  Amplicon Sequence
tgactgcacatggaacattgaggtgcccaacaaccagcatgtgaaggtgcgcttcaaattctt

SEQ ID NO: 2931 - DNA, 81 bp, Artificial Sequence
  Amplicon Sequence
gggctcagctttcagaagtgctgagttggcagttttcttctgtcaccaaaagaggtctcaatgtggaccagctgaacatgt

SEQ ID NO: 2932 - DNA, 70 bp, Artificial Sequence
  Amplicon Sequence
tcacatgccactttggtgtttcataatctcctgggagagattgaccagcagtatagccgcttcctgcaag

SEQ ID NO: 2933 - DNA, 77 bp, Artificial Sequence
  Amplicon Sequence
gaggcgctcaacatgaaattcaaggccgaagtgcagagcaaccggggcctgaccaaggagaacctcgtgttcctggc

SEQ ID NO: 2934 - DNA, 74 bp, Artificial Sequence
  Amplicon Sequence
ccagtggtggtgatcgttcatggcagccaggacaacaatgcgacggccactgttctctgggacaatgcttttgc

SEQ ID NO: 2935 - DNA, 72 bp, Artificial Sequence
  Amplicon Sequence
ctccgaggtgaggaggactctccctcccacatcaaacgcacatcccatgagagtgcataaccagggagaggt

SEQ ID NO: 2936 - DNA, 66 bp, Artificial Sequence
  Amplicon Sequence
ggactcggagacgctgtgcaggagggccgtcaagatcctcaagaagaagaagttgcgaaggatccc

SEQ ID NO: 2937 - DNA, 69 bp, Artificial Sequence
  Amplicon Sequence
catcttccaggaggaccactctctgtggcaccctggactacctgccccctgaaatgattgaaggtcgga

SEQ ID NO: 2938 - DNA, 71 bp, Artificial Sequence
  Amplicon Sequence
aatacccaacgcacaaatgaccgcacgttctctgccccgtttcttgccccagtgtggtttgcattgtctcc

SEQ ID NO: 2939 - DNA, 90 bp, Artificial Sequence
  Amplicon Sequence
cctggaggctgcaacatacctcaatcctgtcccaggccggatcctcctgaagcccttttcgcagcactgctatcctccaaagccattgta

SEQ ID NO: 2940 - DNA, 74 bp, Artificial Sequence
  Amplicon Sequence
gaagatccctttcctcctactgttctttctgtgggaagccgagagccacgaagcatcaaggccgaacatcatcc

SEQ ID NO: 2941 - DNA, 80 bp, Artificial Sequence
  Amplicon Sequence
tgttttgattcccgggcttaccaggtgagaagtgagggaggaagaaggcagtgtcccttttgctagagctgacagctttg

SEQ ID NO: 2942 - DNA, 73 bp, Artificial Sequence
  Amplicon Sequence
gatggagcaggtggctcagttcctgaaggcggctgaggactctggggtcatcaagactgacatgttccagact

SEQ ID NO: 2943 - DNA, 65 bp, Artificial Sequence
  Amplicon Sequence
gcccgaaacgccgaatataatcccaagcggtttgctgcggtaatcatgaggataagagagccacg

SEQ ID NO: 2944 - DNA, 67 bp, Artificial Sequence
  Amplicon Sequence
gaggtcctgagcactgccaggagggacaaaggagcctgtgaacccaggacaagcatggtcccacatc

SEQ ID NO: 2945 - DNA, 67 bp, Artificial Sequence
  Amplicon Sequence
gcagctgcagtcaacagttcaaagaagtcatggcccaaatccagtgtgcacccctccccattcacag

SEQ ID NO: 2946 - DNA, 68 bp, Artificial Sequence
  Amplicon Sequence
ccgggacactttccagaagccgcgggactatttcgccgaagtgagaaggcctcaggacagcgcgttct

SEQ ID NO: 2947 - DNA, 67 bp, Artificial Sequence
  Amplicon Sequence
ccaatcacgacaggaggattcagacacccctaccccacagctctgaccgtcaatgcttccgtgtcca

SEQ ID NO: 2948 - DNA, 80 bp, Artificial Sequence
  Amplicon Sequence
ctgactgctctgcttaaaggtgaaagtagcaggaacaacaacaaaagccaaccaaaaacaaggtagccagtgcaagacat

SEQ ID NO: 2949 - DNA, 76 bp, Artificial Sequence
  Amplicon Sequence
acttcggtgctacttaacaacttacatcccagggagcagtacgtggtccgagctagagtcaacaccaaggcccagg

SEQ ID NO: 2950 - DNA, 79 bp, Artificial Sequence
  Amplicon Sequence
aagaggaacggagcgagtccccgcgcgcggcgcgattccctgagctgtgggacgtgcacccaggactcggctcacacat

SEQ ID NO: 2951 - DNA, 85 bp, Artificial Sequence
  Amplicon Sequence
gacatggagaacaagctgtttgcggggattcggcgggacgggctgctcctgcgtttggtggatgatttcttgttggtgacacctc

SEQ ID NO: 2952 - DNA, 79 bp, Artificial Sequence
  Amplicon Sequence
aggcactgttcatctcagtttttctgtccctttgctcccggcaagctttctgctgaaagttcatatctggagcctgatg

SEQ ID NO: 2953 - DNA, 83 bp, Artificial Sequence
  Amplicon Sequence
ggtgtgccacagaccttcctacttggcctgtaatcacctgtgcagccttttgtgggccttcaaaactctgtcaagaactccgt

SEQ ID NO: 2954 - DNA, 75 bp, Artificial Sequence
  Amplicon Sequence
accagtcccccagaagactatcctgagcccgaggaagtccccccggaggtgatttccatctacaacagcaccagg

SEQ ID NO: 2955 - DNA, 65 bp, Artificial Sequence
  Amplicon Sequence
ggatcgagctcttccagatccttcggccagatgagcacattgccaaacagcgctatatcggtggc

SEQ ID NO: 2956 - DNA, 67 bp, Artificial Sequence
  Amplicon Sequence
gctacgagtgctgtcctggatatgaaaaggtccctggggagaagggctgtccagcagccctaccact

SEQ ID NO: 2957 - DNA, 67 bp, Artificial Sequence
  Amplicon Sequence
gtcatcacctggccttggtcctgtggaactggcagctgtcattgctggaccagtgtgcttcgtctgc

SEQ ID NO: 2958 - DNA, 66 bp, Artificial Sequence
  Amplicon Sequence
aacaccaatgggttccatctttctgggctcctgattgctcaagcacagtttggcctgatgaagagg

SEQ ID NO: 2959 - DNA, 85 bp, Artificial Sequence
  Amplicon Sequence
catccgcaaagtgactgaagagaacaaagagttggccaatgagctgaggcggcctcccctatgctatcacaacggagttcagtac

SEQ ID NO: 2960 - DNA, 67 bp, Artificial Sequence
  Amplicon Sequence
ggacaagaccctctcaggctgtcccaagctcccaagagcttccagagctctgacccacagcctccaa

SEQ ID NO: 2961 - DNA, 75 bp, Artificial Sequence
  Amplicon Sequence
tccctgcggtcccagatagcctgaatcctgcccggagtggaactgaagcctgcacagtgtccaccctgttcccac

SEQ ID NO: 2962 - DNA, 69 bp, Artificial Sequence
  Amplicon Sequence
tcaccctctgtgacttcatcgtgccctgggacaccctgagcaccacccagaagaagagcctgaaccaca

SEQ ID NO: 2963 - DNA, 67 bp, Artificial Sequence
  Amplicon Sequence
ctacctgccttgctttgtgacttccaagaacgagtgtctctggaccgacatgctctccaatttcggt

SEQ ID NO: 2964 - DNA, 73 bp, Artificial Sequence
  Amplicon Sequence
actttgctgggacaaaggtcaactgaagaagtgggcaggcccgaggcaggagagatgctgaggagtccatgtg

SEQ ID NO: 2965 - DNA, 84 bp, Artificial Sequence
  Amplicon Sequence
gccgggaagaccgtaattgtggctgcactggatgggaccttccagaggaagccatttggggccatcctgaacctggtgccgctg

SEQ ID NO: 2966 - DNA, 73 bp, Artificial Sequence
  Amplicon Sequence
aagcagaagggagagcgtaagatcttccaggcacacaagaattgtgggcagatgagtgagattgaggccaagg

SEQ ID NO: 2967 - DNA, 68 bp, Artificial Sequence
  Amplicon Sequence
cagaaggatgcctgtggccctcggagagcacagtgtcaggcaacggaatcccagagccgcaggtctac

SEQ ID NO: 2968 - DNA, 68 bp, Artificial Sequence
  Amplicon Sequence
gaaatcgccagcttcgataaggccaagctgaagaaaacggagacgcaggaaaagaacaccctgccgac

SEQ ID NO: 2969 - DNA, 71 bp, Artificial Sequence
  Amplicon Sequence
cacatcaaagaactactgacaacgaaggccgcgcctgcctttcccatctgtctatctatctggctggcagg

SEQ ID NO: 2970 - DNA, 66 bp, Artificial Sequence
  Amplicon Sequence
agctcggaacctcaccgtgcctggcagccttcgggctgtggacataccgggcctcaaggctgctac

SEQ ID NO: 2971 - DNA, 69 bp, Artificial Sequence
  Amplicon Sequence
ggagaagggtgaccgactcagcgctgagatcaatcggcccgactatctcgactttgccgagtctgggca

SEQ ID NO: 2972 - DNA, 70 bp, Artificial Sequence
  Amplicon Sequence
tctcacctcgctatggttcgtctgcctctgcagtgcgtcctctggggctgcttgctgaccgctgtccatc

SEQ ID NO: 2973 - DNA, 71 bp, Artificial Sequence
  Amplicon Sequence
cctcagcaccagggtaccaggagctgaggagtgtgagcgtgccgtcatcgactttgtggctttccaggaca

SEQ ID NO: 2974 - DNA, 74 bp, Artificial Sequence
  Amplicon Sequence
cttcatcttccctctacccagattgtgaagatggaaagggtccaacccctggaagagaatgtgggaaatgcagc

SEQ ID NO: 2975 - DNA, 72 bp, Artificial Sequence
  Amplicon Sequence
aatccaagggggagagtgatgacttccatatggactttgactcagctgtggctcctcgggcaaaatctgtac

SEQ ID NO: 2976 - DNA, 66 bp, Artificial Sequence
  Amplicon Sequence
tgtggacatcttcccctcagacttccctactgagccaccttctctgccacgaaccggtcgggctag

SEQ ID NO: 2977 - DNA, 82 bp, Artificial Sequence
  Amplicon Sequence
ctatatgcagccagagatgtgacagccaccgtggacagcctgccactcatcacagcctccattctcagtaagaaactcgtgg

SEQ ID NO: 2978 - DNA, 74 bp, Artificial Sequence
  Amplicon Sequence
tgctgttgctgagtctgttgccagtccccagaagaccatgtctgtgttgagctgtatctgtgaagccaggcaag

SEQ ID NO: 2979 - DNA, 81 bp, Artificial Sequence
  Amplicon Sequence
gggccaaatattcagaagcttttatatcagaggaccaccatagcggccatggagaccatctctgtcccatcatacccatcc

SEQ ID NO: 2980 - DNA, 68 bp, Artificial Sequence
  Amplicon Sequence
gcggacttaatgcagagacaaggccagtatgacccacctccaggagccagcaacattttgggacttga

SEQ ID NO: 2981 - DNA, 66 bp, Artificial Sequence
  Amplicon Sequence
gacgctggtctggtgaagatgtccaggaaaccacgagcctccagcccattgtccaacaaccaccca

SEQ ID NO: 2982 - DNA, 73 bp, Artificial Sequence
  Amplicon Sequence
cttcacagtgctcctgcagtctctctgtgtggctgtaacttacgtgtactttaccaacgagctgaagcagatg

SEQ ID NO: 2983 - DNA, 65 bp, Artificial Sequence
  Amplicon Sequence
gcctcggtgtgcctttcaacatcgccagctacgccctgctcacgtacatgattgcgcacatcacg

SEQ ID NO: 2984 - DNA, 69 bp, Artificial Sequence
  Amplicon Sequence
ggagccggatgcagtaggactggactcgggccatatccgtggtgccgtcaacatgcctttcatggactt

SEQ ID NO: 2985 - DNA, 68 bp, Artificial Sequence
  Amplicon Sequence
tgtcaccccgactcaacgtgagacgcaccgcccggactcaccatgcgtgaatgcatctcagtccacgt

SEQ ID NO: 2986 - DNA, 73 bp, Artificial Sequence
  Amplicon Sequence
cgaggacgaggcttaaaaacttctcagatcaatcgtgcatccttagtgaacttctgttgtcctcaagcatggt

SEQ ID NO: 2987 - DNA, 67 bp, Artificial Sequence
  Amplicon Sequence
gtatcaccatcaatgcggctcatgtggagtatagcactgccgcccgccactacgcccacacagactg

SEQ ID NO: 2988 - DNA, 74 bp, Artificial Sequence
  Amplicon Sequence
tgtgtatagtcctgcccctcaaggtgtcacagtaagatgtcggataatccgggataaaaggggaatggatcggg

SEQ ID NO: 2989 - DNA, 68 bp, Artificial Sequence
  Amplicon Sequence
ggaggagctaaatgcctcaggccggtgcactctgcccattgatgagtccaacaccatccacttgaagg

SEQ ID NO: 2990 - DNA, 522 bp, Artificial Sequence
  Amplicon Sequence
gagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaagtggagcccagtgacaccatcgaaaatgtgaaggccaagatccaagataaagaaggcatccctcccgaccagcagaggctcatctttgcaggcaagcagctggaagatggccgcactctttctgactacaacatccagaaggagtcgaccctgcacctggtcctgcgcctgaggggtggctgttaattcttcagtcatggcattcgc

SEQ ID NO: 2991 - DNA, 67 bp, Artificial Sequence
  Amplicon Sequence
acgcaccctgtctgactacaacatccagaaagagtccaccctgcacctggtgctccgtcttagaggt

SEQ ID NO: 2992 - DNA, 67 bp, Artificial Sequence
  Amplicon Sequence
tgtctggcgataaagggatttctgccttccctgaatcagacaaccttttcaaatgggtagggaccat

SEQ ID NO: 2993 - DNA, 73 bp, Artificial Sequence
  Amplicon Sequence
ctccataatttatggcctgcagtatctcttcttggagcccaaccccgaggacccactgaacaaggaggccgca

SEQ ID NO: 2994 - DNA, 73 bp, Artificial Sequence
  Amplicon Sequence
gtgaagccaccgtcatcatgtctgaccaggaggcaaaaccttcaactgaggacttgggggataagaaggaagg

SEQ ID NO: 2995 - DNA, 70 bp, Artificial Sequence
  Amplicon Sequence
accatgctccagaaggaggggccccgagccttctacaaagggttcatgccctcctttctccgcttgggtt

SEQ ID NO: 2996 - DNA, 66 bp, Artificial Sequence
  Amplicon Sequence
ccatgcagcctggaatttgaggctacccagtgccccaacccattctcctacgtgcccaggcctctc

SEQ ID NO: 2997 - DNA, 71 bp, Artificial Sequence
  Amplicon Sequence
tgcggaaatgagctccaccggctccctggccactggggactacactagagcagcggttagaatggctgagg

SEQ ID NO: 2998 - DNA, 67 bp, Artificial Sequence
  Amplicon Sequence
gacagctgatccaggagccacgggtcctgcacttcaaggacagttaccacaacctgcgcctatccat

SEQ ID NO: 2999 - DNA, 68 bp, Artificial Sequence
  Amplicon Sequence
agaacggaggccgtgactgcagcgggacgctgctcgactctaagaactgcacagatgggctgtgcatg

SEQ ID NO: 3000 - DNA, 69 bp, Artificial Sequence
  Amplicon Sequence
ctgaacacagtggagctggtttgcaaactctgtgtgcggcaggtggaaggagaagggcagatcttccag

SEQ ID NO: 3001 - DNA, 70 bp, Artificial Sequence
  Amplicon Sequence
gtggatgtgccctgaaggacaagccaggcgtctacacgagagtctcacacttcttaccctggatccgcag

SEQ ID NO: 3002 - DNA, 79 bp, Artificial Sequence
  Amplicon Sequence
acgggtcctgcctcagttggcggaatggcggccacgggagccaatgcagagaaagctgaaagtcacaatgattgccccg

SEQ ID NO: 3003 - DNA, 89 bp, Artificial Sequence
  Amplicon Sequence
tggcttcaggagctgaataccctcccaggcacacacaggtgggacacaaataagggttttggaaccactattttctcatcacgacagca

SEQ ID NO: 3004 - DNA, 68 bp, Artificial Sequence
  Amplicon Sequence
gataccacaactcccatcaagctgttggcagtggcagccacggcgcctcctgatgcgcctaacaggga

SEQ ID NO: 3005 - DNA, 67 bp, Artificial Sequence
  Amplicon Sequence
ggctttggcagcttcagattcccttcagggaaccagggtggagctggccccagtcagggcagtggag

SEQ ID NO: 3006 - DNA, 71 bp, Artificial Sequence
  Amplicon Sequence
gctgcgacatggatttcgacattgctgggccttccatccggggtgctctggtgctaggttacgagggctgg

SEQ ID NO: 3007 - DNA, 66 bp, Artificial Sequence
  Amplicon Sequence
acccacggacagacttgcgcgcgtccaatgtgtattcctccatcatatgctgaccttggcaaagct

SEQ ID NO: 3008 - DNA, 67 bp, Artificial Sequence
  Amplicon Sequence
gccctggatttcagaaagagccaagtctggatctgggaccctttccttccttccctggcttgtaact

SEQ ID NO: 3009 - DNA, 71 bp, Artificial Sequence
  Amplicon Sequence
ctgctgtcttgggtgcattggagccttgccttgctgctctacctccaccatgccaagtggtcccaggctgc

SEQ ID NO: 3010 - DNA, 73 bp, Artificial Sequence
  Amplicon Sequence
tgtgaatgcagaccaaagaaagatagagcaagacaagaaaatccctgtgggccttgctcagagcggagaaagc

SEQ ID NO: 3011 - DNA, 77 bp, Artificial Sequence
  Amplicon Sequence
agcttcctacagcacaacaaatgtgaatgcagaccaaagaaagatagagcaagacaagaaaaatgtgacaagccgag

SEQ ID NO: 3012 - DNA, 71 bp, Artificial Sequence
  Amplicon Sequence
tgacgatggcctggagtgtgtgcccactgggcagcaccaagtccggatgcagatcctcatgatccggtacc

SEQ ID NO: 3013 - DNA, 83 bp, Artificial Sequence
  Amplicon Sequence
cctcagcaagacgttatttgaaattacagtgcctctctctcaaggccccaaaccagtaacaatcagttttgccaatcacactt

SEQ ID NO: 3014 - DNA, 72 bp, Artificial Sequence
  Amplicon Sequence
tgcccttaaaggaaccaatgagtccctggaacgccagatgcgtgaaatggaagagaactttgccgttgaagc

SEQ ID NO: 3015 - DNA, 67 bp, Artificial Sequence
  Amplicon Sequence
tacaagctgagtgcccaggcgggtgccgaaatggaggcttttgtaatgaaagacgcatctgcgagtg

SEQ ID NO: 3016 - DNA, 75 bp, Artificial Sequence
  Amplicon Sequence
agaggcatccatgaacttcacacttgcgggctgcatcagcacacgctcctatcaacccaagtactgtggagtttg

SEQ ID NO: 3017 - DNA, 74 bp, Artificial Sequence
  Amplicon Sequence
acaaagctaccagggagtcggcctttgtccacgccattgcctcagccggtgtggcctttgcagtgacacgctca

SEQ ID NO: 3018 - DNA, 75 bp, Artificial Sequence
  Amplicon Sequence
gtatcaggaccacatgcagtacatcggagaaggcgcgaagacaggcatcaaagaatgccagtatcaattccgaca

SEQ ID NO: 3019 - DNA, 79 bp, Artificial Sequence
  Amplicon Sequence
tgtcttcagggtcttgtccagaatgtagatgggttccgtaagaggcctggtgctctcttactctttcatccacgtgcac

SEQ ID NO: 3020 - DNA, 67 bp, Artificial Sequence
  Amplicon Sequence
cggtggaatctggctctggctccctctgctcttgacctggctcacccccgaggtcaactcttcatgg

SEQ ID NO: 3021 - DNA, 74 bp, Artificial Sequence
  Amplicon Sequence
atcgcagctggtgggtgtacacactgctgtttaccttggcgaggcctttcaccaagtccatgcaacagggagct

SEQ ID NO: 3022 - DNA, 76 bp, Artificial Sequence
  Amplicon Sequence
gggtagagggaaaagggttcaacaaaggctgaactggattcttaaccaagaaacaaataatagcaatggtggtgca

SEQ ID NO: 3023 - DNA, 73 bp, Artificial Sequence
  Amplicon Sequence
gatacatcgtctgcgaggaattcaaagacgtgctcctgactgcctgggaaaatgagcaggcagtcattgaaag

SEQ ID NO: 3024 - DNA, 70 bp, Artificial Sequence
  Amplicon Sequence
ggagatgaagcccccaagcttcctcagaagcaaccccagaccaaaaccaagcccactcaggcagctggac

SEQ ID NO: 3025 - DNA, 76 bp, Artificial Sequence
  Amplicon Sequence
agactgtggagtttgatgttgttgaaggagaaaagggtgcggaggcagcaaatgttacaggtcctggtggtgttcc

SEQ ID NO: 3026 - DNA, 68 bp, Artificial Sequence
  Amplicon Sequence
catggcctccgctatgaaggcggtgacagagctgaatgaacctctctccaatgaagatcgaaatctcc

SEQ ID NO: 3027 - DNA, 66 bp, Artificial Sequence
  Amplicon Sequence
ctgcgttcacaccccagtgtcacagggcgagctgttctggagagaaaaccatctgtcgtggctgag

SEQ ID NO: 3028 - DNA, 72 bp, Artificial Sequence
  Amplicon Sequence
tgctgagcctcctctccttggcaggggcactgtgatgaggagtaagaactcccttatcactaacccccatcc

What is claimed:

1. A method of predicting clinical outcome for a human subject diagnosed with colorectal cancer following surgical resection of said cancer, comprising:
   assaying a normalized expression level of an RNA transcript, or an expression product thereof, of INHBA, MYBL2, FAP and Ki67 in a biological sample comprising colorectal cancer cells obtained from the human subject;
   determining a likelihood of a positive clinical outcome for the human subject based on the normalized expression, wherein
      (a) normalized expression of each of INHBA and FAP is negatively correlated with an increased likelihood of a positive clinical outcome; and
      (b) normalized expression of each of MYBL2 and Ki67 is positively correlated with an increased likelihood of a positive clinical outcome; and
   providing a report comprising a score, wherein the score is indicative of the likelihood of a positive clinical outcome in the human subject.

2. The method of claim 1 wherein evidence of said normalized expression level is obtained by a method of gene expression profiling.

3. The method of claim 2 wherein said method is a PCR-based method.

4. The method of claim 3 wherein said normalized expression level is normalized relative to the expression level of one or more reference genes, or their expression products.

5. The method of claim 1 wherein said positive clinical outcome is expressed in terms of Recurrence-Free Interval (RFI), Disease-Free Survival (DFS), or Distant Recurrence-Free Interval (DRFI).

6. The method of claim 1 wherein said cancer is Dukes B (stage II) or Dukes C (stage III) colorectal cancer.

7. The method of claim 6 wherein said cancer is Dukes B (stage II) or Dukes C (stage III) colon cancer.

8. The method of claim 1, wherein said assaying comprises assaying a normalized expression level of an RNA transcript, or an expression product thereof, of one or more of BGN, GADD45B, COL1A1, SPARC, COL1A2, and CYMC in the biological sample, wherein (a) normalized expression of each of BGN, GADD45B, COL1A1, SPARC, and COL1A2 is negatively correlated with an increased likelihood of a positive clinical outcome; and
(b) normalized expression of CMYC is positively correlated with an increased likelihood of a positive clinical outcome.

9. A method of predicting in a human subject diagnosed with Dukes B (stage II) or Dukes C (stage III) colorectal cancer a likelihood of recurrence of colorectal cancer following surgical resection of said cancer, comprising:
assaying a normalized expression level of an RNA transcript, or an expression product thereof, of INHBA, MYBL2, FAP and Ki67 in a biological sample comprising colorectal cancer cells obtained from the human subject, wherein
(a) normalized expression of each of INHBA and FAP is negatively correlated with a decreased likelihood of recurrence of colorectal cancer; and
(b) normalized expression of each of MYBL2 and Ki67 is positively correlated with a decreased likelihood of recurrence of colorectal cancer; and
providing a report comprising a score, wherein the score is indicative of the likelihood of a recurrence of colorectal cancer in the human subject.

10. The method of claim 9, wherein said assaying comprises assaying a normalized expression level of an RNA transcript, or an expression product thereof, of one or more of BGN, GADD45B, COL1A1, SPARC, COL1A2, and CYMC in the biological sample, wherein (a) normalized expression of each of BGN, GADD45B, COL1A1, SPARC, and COL1A2 is negatively correlated with a decreased likelihood of recurrence of colorectal cancer; and
(b) normalized expression of CYMC is positively correlated with a decreased likelihood of recurrence of colorectal cancer.

11. The method of claim 9 wherein evidence of said expression level is obtained by a method of gene expression profiling.

12. The method of claim 11 wherein said method is a PCR-based method.

13. The method of claim 9, wherein, if said likelihood of recurrence is predicted to be increased, said human subject is subjected to further therapy following said surgical removal.

14. The method of claim 13 wherein said further therapy is chemotherapy and/or radiation therapy.

15. The method of claim 9, wherein said normalized expression level is normalized relative to the expression level of one or more reference genes, or their expression products.

16. The method of claim 9 wherein, said positive clinical outcome is expressed in terms of Recurrence-Free Interval (RFI), Disease-Free Survival (DFS), or Distant Recurrence-Free Interval (DRFI).

17. The method of claim 9 wherein, said colorectal cancer is Dukes B (stage II) or Dukes C (stage III) colorectal cancer.

18. The method of claim 17 wherein said colorectal cancer is Dukes B (stage II) or Dukes C (stage III) colon cancer.

* * * * *